United States Patent
Zouani

(10) Patent No.: US 11,578,110 B2
(45) Date of Patent: *Feb. 14, 2023

(54) COMPOUNDS FOR INDUCING TISSUE FORMATION AND USES THEREOF

(71) Applicant: HISTIDE AG, Schindellegi (CH)

(72) Inventor: Omar F. Zouani, Einsiedeln (CH)

(73) Assignee: HISTIDE AG, Schindellegi (CH)

( * ) Notice: Subject to any disclaimer, the term of this patent is extended or adjusted under 35 U.S.C. 154(b) by 699 days.

This patent is subject to a terminal disclaimer.

(21) Appl. No.: 15/745,021

(22) PCT Filed: Aug. 25, 2016

(86) PCT No.: PCT/EP2016/070133
§ 371 (c)(1),
(2) Date: Jan. 15, 2018

(87) PCT Pub. No.: WO2017/032856
PCT Pub. Date: Mar. 2, 2017

(65) Prior Publication Data
US 2018/0208635 A1  Jul. 26, 2018

Related U.S. Application Data

(60) Provisional application No. 62/209,411, filed on Aug. 25, 2015.

(30) Foreign Application Priority Data

Dec. 23, 2015  (EP) .................................... 15307127

(51) Int. Cl.
C07K 14/51 (2006.01)
A61L 27/22 (2006.01)

(52) U.S. Cl.
CPC ............. *C07K 14/51* (2013.01); *A61L 27/227* (2013.01); *C07K 2299/00* (2013.01)

(58) Field of Classification Search
None
See application file for complete search history.

(56) References Cited

U.S. PATENT DOCUMENTS

| | | | |
|---|---|---|---|
| 5,436,228 A | 6/1995 | Postlethwaite et al. | |
| 5,846,536 A | 12/1998 | Bissell et al. | |
| 7,132,506 B2* | 11/2006 | Nishimura | A61P 19/10 530/324 |
| 7,378,392 B1 | 5/2008 | Hewick et al. | |
| 7,528,105 B1 | 5/2009 | Pena | |
| 7,691,829 B2 | 4/2010 | Petito et al. | |
| 8,075,562 B2* | 12/2011 | Murphy | A61L 31/16 606/77 |
| 9,402,710 B2 | 8/2016 | Yang et al. | |
| 2002/0123481 A1 | 9/2002 | Oliviero | |
| 2003/0185792 A1 | 10/2003 | Keck et al. | |
| 2004/0023322 A1 | 2/2004 | Goodheart | |
| 2004/0039543 A1 | 2/2004 | Keck | |
| 2006/0205652 A1 | 9/2006 | Zamora et al. | |
| 2009/0087472 A1 | 4/2009 | Murphy et al. | |
| 2010/0167999 A1 | 7/2010 | Vescovi et al. | |
| 2010/0260676 A1 | 10/2010 | Hanson et al. | |
| 2011/0129896 A1 | 6/2011 | Ter Haar et al. | |
| 2011/0207669 A1 | 8/2011 | Vandroux et al. | |
| 2012/0046227 A1 | 2/2012 | Berasi et al. | |
| 2013/0303449 A1 | 11/2013 | Murray et al. | |
| 2013/0337028 A1 | 12/2013 | Balasundaram et al. | |
| 2016/0022875 A1 | 1/2016 | Durrieu et al. | |
| 2018/0305408 A1 | 10/2018 | Zouani | |
| 2019/0016770 A1 | 1/2019 | Zouani | |
| 2019/0224279 A1 | 7/2019 | Zouani et al. | |
| 2019/0225651 A1 | 7/2019 | Zouani | |
| 2019/0290729 A1 | 9/2019 | Zouani et al. | |
| 2019/0330290 A1 | 10/2019 | Zouani et al. | |
| 2019/0374600 A1 | 12/2019 | Zouani et al. | |

FOREIGN PATENT DOCUMENTS

| | | |
|---|---|---|
| DE | 19748688 A1 | 10/1998 |
| EP | 1288228 B1 | 5/2006 |
| EP | 1721909 A1 | 11/2006 |
| EP | 2540739 A1 | 1/2013 |
| FR | 3003173 | 9/2014 |
| FR | 3003173 A1 | 9/2014 |
| JP | 2008512087 A | 4/2008 |
| WO | 91/18098 A2 | 11/1991 |
| WO | 96/40771 A1 | 12/1996 |
| WO | 9708196 A1 | 3/1997 |
| WO | 98/54577 A1 | 12/1998 |

(Continued)

OTHER PUBLICATIONS

Trellet et al. "Unified Conformational Selection and Induced Fit Approach to Protein-Peptide Docking," PLOS One, Mar. 2013, vol. 8, No. 3, e58769-e58769 (Year: 2013).*

Ciemny et al. "Protein-peptide docking: opportunities and challenges," Drug Discovery Today, vol. 23, No. 8, Aug. 2018, pp. 1530-1537 (Year: 2018).*

Zouani et al. "Differentiation of pre-osteoblastcells on poly(ethylene terephthalate) grafted with RGD and/or BMPs mimetic peptides," Biomaterials 31 (2010) 8245-8253 (Year: 2010).*

Madl et al "Presentation of BMP 2 Mimicking Peptides in 3D Hydrogels Directs Cell Fate Commitment in Osteoblasts and Mesenchymal Stem Cells," Biomacromolecules 2014, 15, 445-455 (Year: 2014).*

International Search Report and Written Opinion dated May 3, 2017, International Application No. PCT/EP2016/070132, pp. 1-19.

(Continued)

*Primary Examiner* — Christina Bradley
(74) *Attorney, Agent, or Firm* — MH2 Technology Law Group, LLP

(57) ABSTRACT

The present disclosure provides peptides, or variants or analogs thereof, with between 8 and 30 amino acids, having growth factor receptor-binding capability, wherein the RMSD value of the structure coordinates of said peptide, variant or analog thereof with respect to PEPREF is 2.45 Å (Angstroms) or less.

14 Claims, 17 Drawing Sheets

Specification includes a Sequence Listing.

(56) References Cited

FOREIGN PATENT DOCUMENTS

| WO | 99/26975 A2 | 6/1999 |
|---|---|---|
| WO | 00/20449 A1 | 4/2000 |
| WO | 00/20607 A1 | 4/2000 |
| WO | 01/66164 A1 | 9/2001 |
| WO | 01/76457 A2 | 10/2001 |
| WO | 2005030933 A2 | 4/2005 |
| WO | 2006009836 A2 | 1/2006 |
| WO | 2006009836 A3 | 1/2006 |
| WO | 2006/017619 A2 | 2/2006 |
| WO | 2006/078161 A1 | 7/2006 |
| WO | 2007/0010394 A2 | 1/2007 |
| WO | 2007/094570 A1 | 8/2007 |
| WO | 2007/114851 A1 | 10/2007 |
| WO | 2008/011094 A2 | 1/2008 |
| WO | 2008/015383 A2 | 2/2008 |
| WO | 2008/150119 A1 | 12/2008 |
| WO | 2009/018226 A2 | 2/2009 |
| WO | 2009/055868 A1 | 5/2009 |
| WO | 2010/037395 A2 | 4/2010 |
| WO | 2010/103070 A2 | 9/2010 |
| WO | 2010/127029 A1 | 11/2010 |
| WO | 2011/163398 A2 | 12/2011 |
| WO | 2012057624 A1 | 5/2012 |
| WO | 2012/129448 A1 | 9/2012 |
| WO | 2013/163423 A1 | 10/2013 |
| WO | 2014/140504 A1 | 9/2014 |
| WO | 2014/182676 A2 | 11/2014 |
| WO | 2017/032853 A2 | 3/2017 |
| WO | 2017/032855 A2 | 3/2017 |
| WO | 2017/032858 A2 | 3/2017 |
| WO | 2017032856 A2 | 3/2017 |

OTHER PUBLICATIONS

International Search Report and Written Opinion dated Apr. 25, 2017, International Application No. PCT/EP2016/070135, pp. 1-19.
Keyvan Behnam et al., "BMP binding peptide: a BMP-2 enhancing factor deduced from the sequence of native bovine bone morphogenetic protein/non-collagenous protein", Journal of Orthopedic Research, vol. 23, No. 1, 2005, pp. 175-180.
Omar F. Zouani et al., "Differentiation of pre-osteoblast cells on poly(ethylene terephthalate) grafted with RGD and/or BMPs mimetic peptides", Biomaterials, vol. 31, No. 32, 2010, pp. 8545-8253.
International Search Report and Written Opinion dated Sep. 8, 2017, International Application No. PCT/EP2016/070130, pp. 1-30.
"SubName: Full=Bone morphogenetic protein 4 {ECO:0000313:EMBL:ADD25172.1}; Flags: Fragment;", XP002767065, Apr. 20, 2010, Retrieved from EBI accession No. UNIPROT:D3Y682, Database accession No. D3Y682 sequence, p. 1.
"SubName: Full=Bone morphogenetic protein BMP7 {ECO:0000313:EMBL:AAF89752.1}; Flags:Fragment;", XP002767066, Nov. 1, 2010, Retrieved from EBI accession No. UNIPROT:Q9MZL9, Database accession No. Q9MZL9 sequence, p. 1.
"SubName: Full=Bone morphogenetic protein BMP7 {EC0:0000313:EMBL:AAF89752.1}; Flags:Fragment;", XP002771383, Oct. 1, 2000, Retrieved from EBI accession No. UNIPROT:Q9MZL9, Database accession No. Q9MZL9 sequence, p. 1.
"SubName: Full=Decapentaplegic{EC0:0000313:EMBL:AET10511.1}; Flags:Fragment;", XP002771384, Mar. 19, 2014, Retrieved from EBI accession No. UNIPROT:V9I331, Database accession No. V9I331 sequence, p. 1.
International Search Report and Written Opinion dated May 22, 2017, International Application No. PCT/EP2016/070133, pp. 1-24.
International Search Report and Written Opinion dated May 24, 2017 in PCT Application No. PCT/EP2016/071781, 21 pages.
International Search Report and Written Opinion dated May 24, 2017 in PCT Application No. PCT/EP2016/071785, 23 pages.
International Search Report and Written Opinion dated May 29, 2017 in PCT Application No. PCT/EP2016/071794, 30 pages.
International Search Report and Written Opinion dated May 29, 2017 in PCT Application No. PCT/EP2016/071795, 30 pages.
Geiger, M. et al., "Collagen sponges for bone regeneration with rhBMP-2.", Advanced Drug Delivery Reviews, vol. 55, No. 12, Nov. 28, 2003, XP002764796, pp. 1613-1629.
Ide, H. et al., "Growth regulation of human prostate cancer cells by bone morphogenetic protein-2", Cancer Research, vol. 57, No. 22., Nov. 15, 1997, XP002441978, pp. 5022-5027.
Liao, A. et al., "Bone morphogenetic protein 2 mediates epithelial-mesenchymal transition via AKT and ERK signaling pathways in gastric cancer", Tumor Biology, vol. 36, No. 4, Dec. 3, 2014, XP036092591, pp. 2773-2778.
Petty, W.J. et al., "Epidermal Growth Factor Receptor Tyrosine Kinase Inhibition Represses Cyclin D1 in Aerodigestive Tract Cancers", Clinical Cancer Research, vol. 10, No. 22, Nov. 14, 2004, XP055188457, pp. 7547-7554.
Park, H. et al., "Preventing MEK1 activation influences the responses of human osteosarcoma cells to bone morphogenetic proteins 2 and 9", Anti-Cancer Drugs, vol. 24, No. 3, Mar. 2013, XP009192664, pp. 278-290.
Xiong J. et al., "Integrin signaling in control of tumor growth and progression", International Journal of Biochemistry and Cell Biology, vol. 45, No. 5, Feb. 18, 2013, XP028529158, pp. 1012-1015.
Herrera, B. et al., "Potential roles of bone morphogenetic protein (BMP)-9 in human liver diseases", International Journal of Molecular Sciences, vol. 15, No. 4, Mar. 25, 2014, XP002768701, pp. 5212-5213.
Ulrike Maegdefrau et al., "BMP activated Smad signaling strongly promotes migration and invasion of hepatocellular carcinoma cells", Experimental and Molecular Pathology, vol. 92, No. 1, 2011, pp. 74-81.
Bruyer et al., "Cd200 is a potent new growth factor in multiple myeloma through igf-1r interaction," Blood, 2017, 130 3045, pp. 1-7.
Molek et al., "Peptide phage display as a tool for drug discovery: targeting membrane receptors," Molecules, 2011, 16:857-887.
Shamah et al., "Complex target selex," Acct. Chem. Res., 2008, 41:130-138.
Humphries et al., "Integrin ligands at a glance," J. Cell Sci., 2006, 119:3901-3903.
Yampolsky et al., "The exchangeability of amino acids in proteins." Genetics, 2005,1459-1472.
Moore et al., GenBank entry AAI05185 for bovine collagen type I, uploaded Jan. 2007.
Miyazono et al., "Bone morphogenetic protein receptors and signal transduction," J. Biochem., 2010, 147:35-51.
Saxena et al., "Perturbation of canonical and non-canonical bmp singaling affects migration, polarity and dendritogenesis of mouse cortical neurons," Development, 2018,145 dev147157, pp. 1-18.
Zha et al. "Targeting the insulin-like growth factor receptor-1r pathway for cancer therapy." Clin. Can. Res. (20 1 0) 16(9) p. 2512-2517.
Deng et al., "Dystroglycan is required for polarizing the epithelial cells and the oocyte in *Drosophila*." Development (2003) 130 p. 173-184.
Milner-White et al., "Predicting the conformations of peptides and proteins in early evolution." Biol. Dir. (2008) 3(3), pp. 1-9.
Creighton, Thomas E., "Stability of alpha-helicies," Nat. (1987) 326:547-548.
Irbäck et al., PROFASI documentation, http:1/cbbp.thep.lu.se/activities/profasi/regul.html, generated 2016, obtained Jan. 28, 2020.
Bywater et al., https://www.researchgate.net/post/Why_do_we_perform_an_energy_minimization_step_for_protein, Jan. 2015, pp. 1-5, obtained Feb. 21, 2020.
Khandelia et al., "The impact of peptides on lipid membranes." Biochim. Biophys. et Acta, 2008,1778: 1528-1536.
Kato et al., "Mutational analysis of protein solubility enhancement using short peptide tags," Biopolymers, 2006, 85:12-18.
U.S. Appl. No. 16/537,014 to Zouani, Omar F., filed Aug. 9, 2019.
Dean, "Cyclic-dependent kinase 4/6 inhibition in cancer therapy," Cell Cycle, 2012, 11:3913-3918.

(56) References Cited

OTHER PUBLICATIONS

Caymen Chemical, Inc., https://www.caymanchem.com/product/16273/pd-0332991-(hydrochloride), pp. 1-3, retrieved on Dec. 8, 2019 (Year: 2019).
Author unknown, https://www.genscript.com/protein/Z02913-BMP_2_Human.html., pp. 1-6, retrieved on Dec. 8, 2019 (Year: 2019).
Brawley, Otis, http://www.cnn.com/2009/HEALTH/expert.q.a/04/15/human.growth.hormone.cancer/index.html (2009), obtained Feb. 19, 2020, one page.
Carragee, Eugene J. et al., "Cancer risk after use of recombinant bone morphogenetic protein-2 for spinal arthrodesis", J. Bone Joint Surg. Am. (2013) 95 p. 1537-1545.
Gallagher, Emily J. and LeRoith, Derek, "Minireview: IGF, Insulin, and Cancer", Endocrinology (2011) 152 p. 2546-2551.
Heldin, Carl-Henrik, "Targeting the PDGF signaling pathway in tumor treatment" Cell Commun. Signal. (2013) 11(97), pp. 1-18.
Li, Hong et al., "Hydroxyapatite coating enhances polyethylene terephthalate artificial ligament graft osseointegration in the bone tunnel", Int. Orthopaed. (2011) 35 p. 1561-1567.
Lieu, Christopher et al., "Beyond VEGF: inhibition of the fibroblast growth factor pathway and antiangiogenesis", Clin. Canc. Res. (2011) 17(19) p. 6130-6139.
Liu, Edison, "Cancer treatments for the 21st century", Hearing before the Senate Cancer Coalition, Washington D.C., 1998, pp. 1-9.
Luo, Xiaoji et al., "Osteogenic BMPs promote tumor growth of human osteosarcomas that harbor differentiation defects", Lab. Invest. (2008) 88 p. 1264-1277.
Maccauro, Giulio et al., "Physiopathology of spine metastasis." Int. J. Surg. Oncol. (2011) article ID 107969, pp. 1-8.
Mendelsohn, John and Baselga, Jose, "The EGF receptor family as targets for cancer therapy", Oncogene (2000) 19 p. 6550-6565.
Nikinmaa Mikko on Researchgate (2015), https://www.researchgate.net/post/Why_are_mRNA_level_changes_often_taken_to_indicate_functional_protein_activity_changes_although_the_two_..., obtained Feb. 20, 2020, pp. 1-5.
The University of Iowa's web page for peripheral neuropathy, https://uihc.org/health-topics/peripheral-neuropathy-persons-cancer, obtained Feb. 20, 2020, pp. 1-6.
Author Unknown, website: https://www.genscrpt.com/protein.Z02750-Bone-4_BMP-4_Human.html?page_no=1&position_no=1&sensors=search_information, Retrieved on Sep. 14, 2020, pp. 1-5.
Mayo Clinic, "Breast cancer types: What your type means", Retrieved from the Internet on Sep. 24, 2020 https://www.mayoclinic.org/diseases-conditions/breast-cancer/in-depth/breast-cancer/art-20045654?p=1, pp. 1-4.
Jingfeng Li et al., "Repair of Rat Cranial Bone Defects with nHAC/PLLA and BMP-2-Related Peptide or rhBMP-2", Journal of Orthopaedic Research, Nov. 2011, pp. 1745-1752.
Kohei Miyazono et al., "Bone morphogenetic protein receptors and signal transduction", The Journal of Biochemistry, vol. 147, No. 1, 2010, pp. 35-51.
Peter Molek et al., "Peptide Phage Display as a Tool for Drug Discovery: Targeting Membrane Receptors", Molecules, vol. 16, 2011, pp. 857-887.
Steven R. Hubbard et al., "Receptor tyrosine kinases: mechanisms of activation and signaling", Current opinion in cell biology, vol. 19, No. 2, 2007, pp. 117-123.
Wagner Ricardo Montor et al., "Receptor tyrosine kinases and downstream pathways as druggable targets for cancer treatment: the current arsenal of inhibitors", Molecular Cancer, vol. 17, No. 55, 2018, pp. 1-18.
Michael Hopfner et al., "Growth factor receptors and related signalling pathways as targets for novel treatment strateies of hepatocellular cancer," World Journal of Gastroenterology, vol. 14, No. 1, Jan. 2008, pp. 1-14.
Thomas Kirsch et al., "BMP-2 antagonist emerge from alterations in the low-affinity binding epitode for receptor BMPR-II," The EMBO Journal, vol. 19, No. 13, 2000, pp. 3314-3324.
Pandit et al., TASSER-Lite: An Automated Tool for Protein Comparative Modeling, Biophysical Journal, vol. 91:4180-4190 (Dec. 2006) (Year: 2006).
Kosloff et al., Sequence-similar, structure-dissimilar protein pairs in the PDB, Proteins, vol. 71: 891-902. https://doi.org/10.1002/prot.21770 (May 2008).
Carugo, Statistical validation of the root-mean-square-distance, a measure of protein structural proximity, Protein Engineering, Design & Selection vol. 20 No. 1 pp. 33-38, 2007, Published online Jan. 11, 2007 doi:10.1093/protein/gzl051 (Year: 2007).
Carugo, How root-mean-square distance (r.m.s.d.) values depend on the resolution of protein structures that are compared. Journal of Applied Cystallography, vol. 36:125-128 (2003) (Year: 2003).
ADD25172.1, GenBank ADD25172.1, bone morphogenetic protein 4, partial [Gallus gallus], Direct Submission (Jan. 8, 2010); (Year: 2010).
ACU26076.1, GenBank ACU26076.1, bone morphogenetic protein 4, partial [Capra hircus], Direct Submission (Jul. 1, 2009) (Year: 2009).
Gan et al., Analysis of Protein Sequence/Structure Similarity Relationships, Biophysical Journal, vol. 83:2781-2791 (Nov. 2002) (Year: 2002).
Rivlin, Noa et al., "Mutations in the p53 tumor suppressor gene: important milestones at the various steps of tumorigenesis." Genes and Canc.,Apr. 2011, 2(4) pp. 466-474.
Gordon, Kelly J. et al., "Bone morphogenetic proteins induce pancreatic cancer cell invasiveness through a smad1-dependent mechanism that involves matrix metalloproteinase-2." Carcinogenesis, Feb. 2009, 30(2) pp. 238-248.
Howes, Laura, "Deepmind ai predicts protein structures." C&EN, Dec. 1, 2020.
Wang, L., Park, P., Zhang, H., La Marca, F., Claeson , A., Valdivia, J., & Lin , CY (2011). BMP-2 inhibits the tumorigenicity of cancer stem cells in human osteosarcoma OS99-1 cell line. Cancer Biology & Therapy, 11 (5), 457-463.
Rink, R., "To protect peptide pharmaceuticals against peptidases", Journal of Pharmacological and Toxicological Methods, 2010, vol. 61, pp. 210-218.
Human Bone Morphogenetic Protein—2 (BMP—2), Protein Data Bank, PDB ID:2QJ9,2000, https://files.rcsb.org/view/3BMP.pdb.

\* cited by examiner

Titanium | Titanium-Peptide-FITC (SEQ ID NO: 1)

Fig. 9
(a) 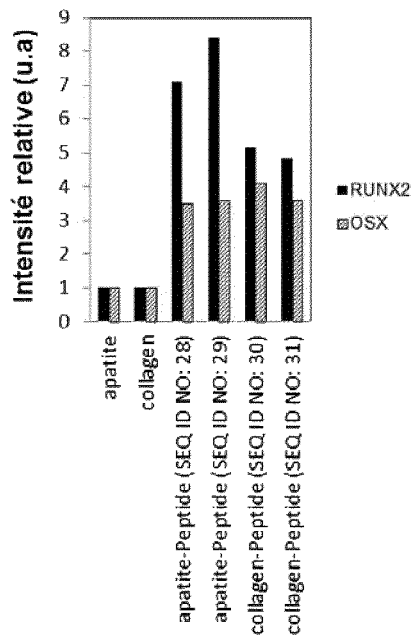 (b) 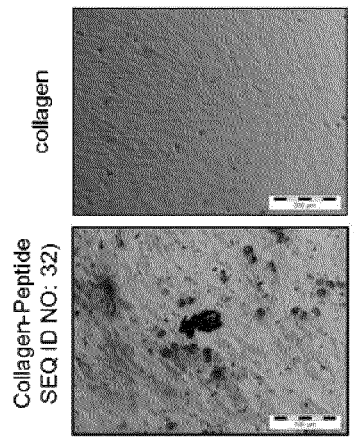
Fig. 10
collagen      Collagen-Peptide (SQ ID NO: 33)
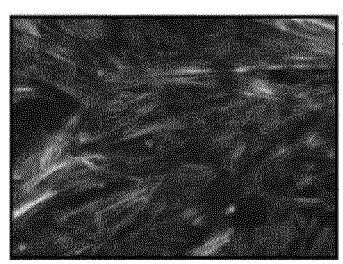 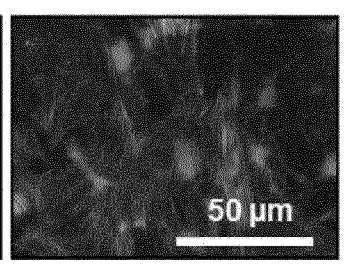

Fig. 15
(a)  (b)
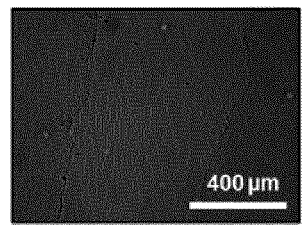
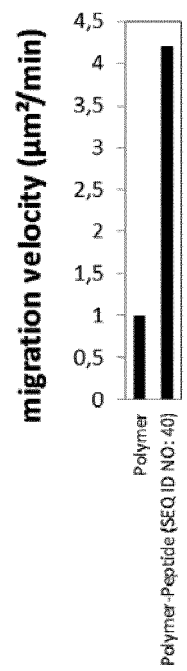

FIG. 20

Fig. 23
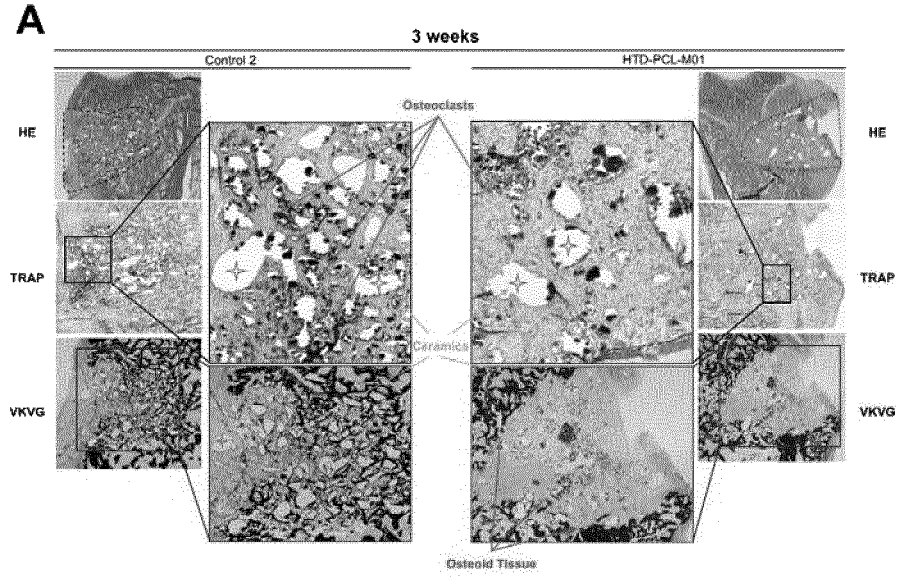
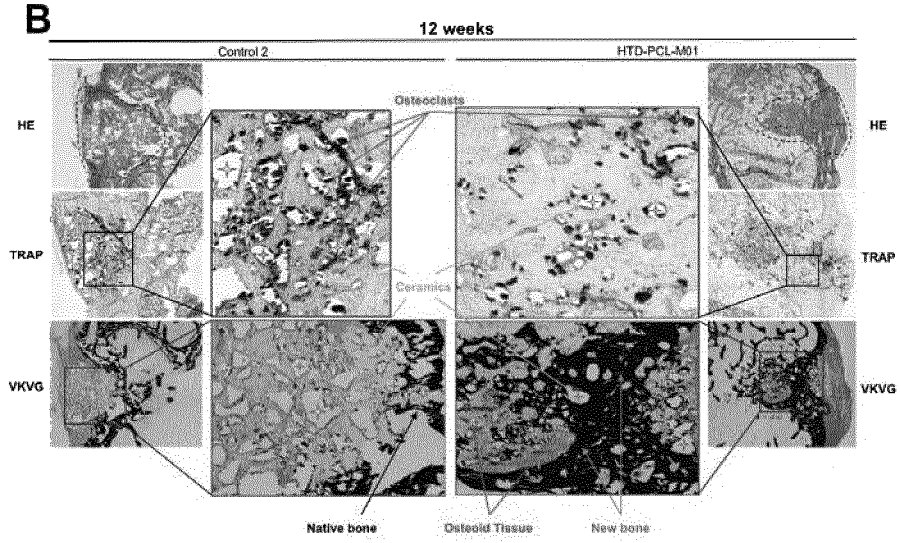

COMPOUNDS FOR INDUCING TISSUE FORMATION AND USES THEREOF

CROSS-REFERENCE TO RELATED APPLICATIONS

This application is a U.S. National Stage application of International Application No. PCT/EP2016/070133 filed 25 Aug. 2016, which claims priority to U.S. Provisional Application No. 62/209,411 filed 25 Aug. 2015 and European Application No. 15307127.9 filed 23 Dec. 2015, the entire disclosures of which are hereby incorporated by reference in their entireties.

SEQUENCE LISTING

The instant application contains a Sequence Listing which has been submitted electronically in ASCII format and is hereby incorporated by reference in its entirety. Said ASCII copy, created on 4 Dec. 2019, is named 0177.0136_ST25.txt and is 1,988,569 bytes in size.

FIELD OF THE INVENTION

The invention relates to compounds for inducing tissue formation, biomaterials and medical devices comprising such compounds, such compounds for use in medical methods and use of such compounds in non-medical methods.

BACKGROUND

Tissue regeneration forms an important part of the healing process subsequent to disease, trauma, or surgery. In situations where disease or trauma produces a tissue defect, for example a bone, cartilage, skin, vascular tissue, or eye retina defect, tissue regeneration is a central goal of recovery. It is not, however, a goal that is always or easily achieved and much research has been devoted to newer and more effective ways to promote tissue repair and regeneration. Conventional technics to achieve tissue regeneration involve the activation of tissue-specific stem cells present in adult tissues with repair and/or regenerative capabilities called mesenchymal stem cell(s) or MSC(s) using recombinant proteins called growth factors (GFs). MSCs or MSC-like cells may be found in the bone marrow, but also in tissues such as fat, umbilical cord blood, amniotic fluid, placenta, dental pulp, tendons, synovial membrane and skeletal muscle. Natural regulation of the MSCs is effected through the participation of a number of growth factors (GFs), including vascular endothelial growth factors (VEGF), which trigger angiogenesis crucial for the repair of most tissues, bone morphogenetic proteins (BMP), which induce the formation of new bone and regulate capillary stem cell activation, transforming growth factors (TGF), which induce cartilage formation, and platelet-derived growth factor-BB (PDGF-BB), which is involved in the formation of granulation tissues and the recruitment of stem cells. Naturally occurring growth factors are found within the tissues themselves and are only present in small amounts. Thus, to provide industrially useful and reproducible amounts of human growth factors, traditional technics involve the production of GFs by genetic recombination. These recombinant molecules are typically grafted onto the surface of a biocompatible material and placed, where needed, inside or on the body of a patient.

Bone

It is conventionally known that mature osteoblasts are the cells responsible for bone formation and are derived from osteoblast precursors. Differentiation of human bone marrow mesenchymal stem cells and osteoblast precursors is one of the important processes for bone regeneration. Osteoblasts differentiate from mesenchymal stem cells. Mature osteoblasts differentiate from osteoblast precursors and into osteocytes which are non-dividing cells. Upon cell activation osteoblasts begin to secrete some extracellular matrix around themselves. Calcification, i.e., deposition of insoluble calcium salts in the bone matrix, begins a short time after the matrix has been secreted. Upon termination of bone matrix synthesis, osteoblasts either undergo cell death by apoptosis or differentiate into osteocytes or bone lining cells. Mesenchymal stem cells are found in large numbers in the periosteum, the fibrous-like layer on the outside surface of bones, and in the bone marrow. During cellular differentiation of osteoblasts, the developing progenitor cells express the regulatory transcription factor Cbfa1/Runx2. A second important transcription factor required for osteoblastic differentiation is osterix. Osteoprogenitors differentiate under the influence of growth factors. Important growth factors in skeletal differentiation include bone morphogenetic proteins (BMPs), transforming growth factor beta (TGF-β) and fibroblast growth factors (FGFs). Differentiation of osteoblasts is also characterized by the expression of alkaline phosphatase as an early marker of pre-osteoblasts. As a result, acting on the differentiation cycle of mammal bone marrow mesenchymal stem cells and osteoblast precursors may have applications in bone tissue regeneration.

Osteoporosis

Osteoporosis is a progressive bone disease that is characterized by a decrease in bone mass and density which can lead to an increased risk of fracture. In osteoporosis, the bone mineral density (BMD) is reduced, bone microarchitecture deteriorates, and the amount and variety of proteins in bone are altered. Osteoporosis is defined by the World Health Organization as a bone mineral density of 2.5 standard deviations or more below the mean peak bone mass (average of young, healthy adults) as measured by dual-energy X-ray absorptiometry; the term "established osteoporosis" includes the presence of a fragility fracture. The treatment of osteoporotic fractures is often hindered by reduced bone healing and higher rates of complications. Studies in osteoporotic animal models revealed delayed callus formation and enchondral ossification, resulting in impaired biomechanical properties of the bone. The cellular sources of fracture healing are mesenchymal stem cells (MSCs). MSCs migrate to the fracture site, where they proliferate and differentiate into osteoblasts upon stimulation with osteoinductive cytokines. Molecular biological alterations of MSCs, such as decreased proliferative capacity, production of collagen I deficient matrix, preferableness of adipogenic differentiation, and impaired osteogenic differentiation have been described in osteoporotic patients. With regards to the osteoinduction of MSCs, key agents are BMPs. Of these, BMP-2 is one of the most potent osteoinductive cytokines which physiologically contributes to the early phase of fracture healing. Beyond that, BMP-2 is already clinically approved for the treatment of distinct fracture entities. The predominant role of BMP-2 in osteoinduction and bone formation led to a scientific quest regarding its involvement in the pathophysiology of osteoporosis. Osteoporotic animal models revealed inconsistent data with regard to BMP-2 expression levels. BMP-2 was found to be overexpressed in the callus of mandibles and down-regulated in MSCs derived from tibial and femoral bone. In humans, genetic polymorphisms in BMP-2 have been identified as risk factors for the development of familial osteoporosis and osteoporotic fractures. All these findings directly link the BMP pathways to osteoporosis. Other studies investigated the therapeutic potential of BMP-2 in osteoporotic animal models. The systemic administration of rhBMP-2 increased the volume of trabecular bone and stimulated bone formation in osteoporotic mice. The local application of adenoviral BMP-2 at the site of injury enhanced callus formation and improved mechanical properties of the healing bone in osteoporotic sheep. Stimulating the differentiation of MSCs and/or inducing growth factor activity, in particular of BMPs, may thus lead to the development of new osteoporosis treatments.

Cartilage

Although native chondrocytes offer little assistance to injured articular cartilage, these cells are responsible for the synthesis and turnover of the cartilage extracellular matrix (ECM), which provides an environment of nutrition diffusion for chondrocytes and provides the joint surface with biomechanical competence. Chondrogenic cells arise from pluripotential adult mesenchymal stem cells (MSCs) through a series of differentiation pathways. Subsequently, it was shown that a number of cytokines and transcription factors are involved in chondrocyte maturation and cartilage formation. Chondrogenic differentiation of MSCs is induced by various intrinsic and extrinsic factors. Growth factors play the most important role in this process. They represent a group of biologically active polypeptides produced by the body, which can stimulate cell proliferation, differentiation and maturation. In the hyaline cartilage, growth factors regulate homeostasis and integrity, as well as development. Important growth factors intervening in cartilage regeneration include TGF-β1, TGF-β3, BMP-2, BMP-4, BMP-7 and GDF-5. As a result, acting on the differentiation cycle of mammal mesenchymal stem cells and chondroblast precursors may have applications in cartilage tissue regeneration.

Muscles

Skeletal muscle is a highly complex and heterogeneous tissue serving a multitude of functions in the organism. The process of generating muscle—myogenesis—can be divided into several distinct phases. During embryonic myogenesis, mesoderm-derived structures generate the first muscle fibers of the body proper, and in subsequent waves additional fibers are generated along these template fibers. In the perinatal phase, muscle resident myogenic progenitors initially proliferate extensively but, later on, decrease as the number of myonuclei reaches a steady state and myofibrillar protein synthesis peaks. Once the muscle has matured, these progenitors will enter quiescence and henceforth reside within it as satellite cells. Adult skeletal muscle, like all renewing organs, relies on a mechanism that compensates for the turnover of terminally differentiated cells to maintain tissue homeostasis. This type of myogenesis depends on the activation of satellite cells that have the potential to differentiate into new fibers. The most comprehensively studied form of myogenesis takes place when mature muscle is damaged and large cohorts of satellite cells expand mitotically and differentiate to repair the tissue and reestablish homeostasis. Many similarities, such as common transcription factors and signaling molecules, between embryonic myogenesis and regeneration in the mature skeletal musculature have been discovered. It is now generally accepted that satellite cells are closely related to progenitors of somitic origin. The activation of the network of transcription factors that controls skeletal muscle development depends on paracrine factors that are released by adjacent tissues, such as the neural tube, notochord, surface ectoderm and lateral mesoderm. Several secreted factors have been identified that determine the spatial and temporal onset of myogenesis. However, no consensus has been reached as to whether these molecules instruct naive cells (instructive induction), amplify a pool of committed progenitors and/or enable a default differentiation pathway (permissive induction) or primarily prevent programmed cell death of muscle progenitor cells. Sonic hedgehog (SHH) and WNT signaling have been reported to have pivotal roles in the induction of myogenesis. Likewise, other signalling molecules, such as Noggin and bone morphogenetic proteins (BMPs)—which inactivate and activate receptors of the transforming growth factor-β (TGFβ) superfamily, respectively—are known to play an important part in orchestrating the activation of myogenesis. Muscle tissue degenerative diseases or disorders include, but are not limited to, myopathies, muscular atrophy, disuse atrophy, denervation atrophy, muscular dystrophies such as the Duchenne muscular dystrophy (DMD), and the Becker muscular dystrophy (BMD), fibrosis, fibrositis, muscle weakness, fatigue, cramps, fibromyalgia, or chronic muscle pain syndrome.

Vascular

The vasculature in the human body forms through two distinct processes: vasculogenesis and angiogenesis. Vasculogenesis is defined as the process of de novo blood vessel formation occurring when endothelial precursor cells (angioblasts) migrate and differentiate into endothelial cells which form the new vessel. These vascular trees are then extended through angiogenesis which is defined as the new vessel formation secondary to proliferation of endothelial cells from pre-existing vessels. Vasculogenesis as well as angiogenesis occur during the embryologic development of the circulatory system but also in the adult organism from circulating endothelial progenitor cells (derivatives of stem cells) able to contribute, albeit to varying degrees, to neovascularization. An example of where these processes can occur in adults is the revascularization following trauma, e.g., after cardiac ischemia. It is known that the ablation of the endothelial progenitor cells (EPCs) in the bone marrow leads to a significant decrease in the vasculature development which would place endothelial progenitor cells as a novel therapeutic target. The differentiation of the EPCs is a consequence of the interplay amongst different signaling molecules such as growth factors. These include FGF, VEGF, PDGF and others. Vascular endothelial growth factor (VEGF) is a signal protein produced by cells that stimulates vasculogenesis and angiogenesis. It is part of the system that restores the oxygen supply to tissues when blood circulation is inadequate. VEGF is a sub-family of growth factors, to be specific, the platelet-derived growth factor family of cystine-knot growth factors. VEGF causes an important signaling cascade in endothelial cells. Binding to VEGF receptor-2 (VEGFR-2) starts a tyrosine kinase signaling cascade that stimulates the production of factors that variously stimulate vessel permeability, proliferation/survival, migration and finally differentiation into mature blood vessels. Recent reports have also indicated that different somatic cells (other than the EPCs) could be reprogrammed towards distinct endothelial cell lineages. This somatic reprogramming as well as the stimulation of EPCs differentiation, both represent promising therapeutic targets in regenerative vascular medicine.

Wound Healing

Wound healing is a complex and dynamic process of replacing devitalized and missing cellular structures and tissue layers. Upon injury to the skin, a set of complex biochemical events takes place in a closely orchestrated cascade to repair the damage and restore the protective barrier which in the normal skin is formed by the epidermis (outermost layer) and the dermis (inner or deeper layer) which exist in a steady-state equilibrium. The human adult wound healing process can be divided into 4 distinct phases: hemostasis, inflammatory, fibroblastic, and maturation (or remodeling). These phases are initiated and regulated by various secreted factors such as growth factors. In the first phase, the damaged blood vessels are sealed via different substances secreted by the platelets such as the platelet-derived growth factor (PDGF). The second phase corresponds to an inflammatory response which causes the blood vessels to become leaky thus releasing plasma and PMN's into the surrounding tissue. The neutrophils phagocytize debris and microorganisms and provide the first line of defence against infection. The cells macrophages are able to phagocytize bacteria and provide a second line of defence. They also secrete a variety of chemotactic and growth factors such as fibroblast growth factor (FGF), epidermal growth factor (EGF), transforming growth factor beta (TGF β and interleukin-1 (IL-1) which appears to direct the next stages of wound healing. The third phase involves the replacement of dermal and subdermal tissues. The fibroblasts secrete the collagen framework onto which further dermal regeneration occurs. The pericytes which regenerate the outer layers of capillaries and the endothelial cells which produce the lining are involved in the angiogenesis. The keratinocytes are responsible for the epithelialization. In the final stage of epithelializtion, contracture occurs as the keratinocytes differentiate to form the protective outer layer or stratum corneum. The last and 4th phase of wound healing involves remodeling the dermal tissues to produce greater tensile strength. The principle cells involved in this process are the fibroblasts. For a wound to heal successfully, all four phases must occur in the proper sequence and time frame. Many factors can interfere with one or more phases of this process, thus causing improper or impaired wound healing. Recent research has also shown that adult stem cells could be involved in wound healing. In particular hematopoietic progenitor cells (that give rise to mature cells in the blood) may have the ability to de-differentiate back into hematopoietic stem cells and/or trans-differentiate into non-lineage cells, such as fibroblasts. It is thought that the extent of the stem cell involvement in skin wound healing is complex as the epidermis and dermis could be reconstituted by mitotically active stem cells that reside at the apex of rete ridges (basal stem cells or BSC), the bulge of hair follicles (hair follicular stem cell or HFSC), and the papillary dermis (dermal stem cells). Moreover, the bone marrow may also contain stem cells that could play a major role in cutaneous wound healing. Therefore, activating adult stem cells as well as the different cells and growth factors intervening during the four phases of the skin wound healing process, most certainly represents a promising therapeutic target.

Tissue Closure

Wound healing not only applies to skin tissue repair but also to the closure of all tissue layers damaged e.g. in an injury or during surgery. For instance, during bone repair surgery, the different layers of tissues incised in order for the surgeon to reach the damaged bone part and repair it would all need to be closed for the overall healing process to occur. The mediation of this complex, "multi-layered" healing process, involves the participation of many different factors such as growth factors.

Neurons

For a long time, the human nervous system has been considered fixed and incapable or regeneration since neurons do not divide within the central nervous system (CNS). Recently in has been discovered that neural cells can be regenerated from neural stem cells (NSCs). These are self-renewing, multipotent adult stem cells that generate the main phenotype of the nervous system. They undergo asymmetric cell division into two daughter cells, one non-specialized and one specialized. NSCs primarily differentiate into neurons, astrocytes, and oligodendrocytes. NSCs are generated throughout an adult's life via the process of neurogenesis. NSCs can be differentiated to replace lost or injured neurons or in many cases even glial cells. NSCs are stimulated to begin differentiation via exogenous cues from their microenvironment, or the neural stem cell niche. This niche defines a zone in which stem cells are retained after embryonic development for the production of new cells of the nervous system. This continual supply of new neurons and glia then provides the postnatal and adult brain with an added capacity for cellular plasticity. Critical to the maintenance of the stem cell niche are microenvironmental cues and cell-cell interactions that act to balance stem cell quiescence with proliferation and to direct neurogenesis versus gliogenesis lineage decisions. Several proteins like different growth factors are involved in the mechanisms of the neural stem cell niche as well as in the maintenance and growth of the newly formed neurons. These include the BMPs, FGFs, PDGF, VEGF, TGF β, BDNF and others. Nerve growth factor (NGF) is a small secreted protein that is important for the growth, maintenance, and survival of certain target neurons (nerve cells). It also functions as a signaling molecule. While "nerve growth factor" refers to a single factor, "nerve growth factors" refers to a family of factors also known as neurotrophins. Other members of the neurotrophin family that are well recognized include Brain-Derived Neurotrophic Factor (BDNF), Neurotrophin-3 (NT-3), and Neurotrophin 4/5 (NT-4/5). NGF is critical for the survival and maintenance of sympathetic and sensory neurons. Without it, these neurons undergo apoptosis. Nerve growth factor causes axonal growth. Studies have shown that it causes also axonal branching and elongation. Several brain diseases are considered to be caused by disorders in the neural stem cell niche and especially in the precise signaling of this microenvironment. Therefore restoring correct growth factor signaling is a promising target for the treatment of brain diseases.

Eye Retina

The vertebrate retina is a light-sensitive layer of tissue, lining the inner surface of the eye. Light striking the retina initiates a cascade of chemical and electrical events that ultimately trigger nerve impulses. These are sent to various visual centers of the brain through the fibers of the optic nerve. In vertebrate embryonic development, the retina and the optic nerve originate as outgrowths of the developing brain, so the retina is considered part of the central nervous system (CNS) and is actually brain tissue. Retinal development involves a complex progression of tissue induction, proliferation of retinal progenitor cell (RPC) populations and terminal differentiation of these cells into specific functional types. Growing evidence indicates that several extrinsic cues play a critical role in the retinal cell development. One such extrinsic molecule type, bone morphogenetic protein (BMP), is a member of the transforming growth factor (TGF)-β family of signaling molecules, which are known to regulate a variety of cell functions in the developing nervous system, including neural induction, cell fate determination, apoptosis, and proliferation. BMP-2, -4, and -7 and their receptors (BMPRs) are expressed in the eye during embryogenesis and are essential for multiple aspects of retinal development. There are many inherited and acquired diseases or disorders that may affect the retina like for example the macular degeneration. It is a degenerative disease that usually affects older adults and results in a loss of vision in the center of the visual field (the macula) because of damage to the retina. Age-related macular degeneration is the leading cause of irreversible blindness in North America. Regenerating the retina via the growth factor signaling responsible for its development is thus a significant potential therapeutic target.

Kidneys

The kidney is a complex tissue consisting of several different cell types including glomerular podocytes, endothelial cells, mesangial cells, interstitial cells, tubular epithelial cells, and connecting duct cells. These cell types interact to establish a precise cellular environment that functions as an efficient tissue. Kidney diseases are currently a global public health problem, with an incidence that has reached epidemic proportions and continues to climb worldwide. Kidney failure can be associated with chronic kidney disease (CKD), which is a progressive loss in renal function over a period of months or years. Renal fibrosis, the common pathological feature of CKDs, is characterized by excessive accumulation of ECM (extracellular matrix). TGF-β (transforming growth factor-β) and BMP-7 (bone morphogenetic protein-7), two key members in the TGF-β superfamily, play important but diverse roles in CKDs (chronic kidney diseases). Both TGF-β and BMP-7 share similar downstream Smad signalling pathways, but counter-regulate each other to maintain the balance of their biological activities. During renal injury in CKDs, this balance is significantly altered because TGF-β signalling is up-regulated by inducing TGF-β1 and activating Smad3, whereas BMP-7 and its downstream Smad1/5/8 are down-regulated. In the context of renal fibrosis, Smad3 is pathogenic, whereas Smad2 and Smad7 are renoprotective. However, this counter-balancing mechanism is also altered because TGF-β1 induces Smurf2, an ubiquitin E3-ligase, to target Smad7 as well as Smad2 for degradation. Thus overexpression of renal Smad7 restores the balance of TGF-β/Smad signaling and has therapeutic effect on CKDs. It may this be that restoring the BMP-7 signaling is a potential therapeutic target in renal regenerative therapies.

Ligaments and Tendons

Tendons and ligaments (T/L) are dense connective tissues of mesodermal origin. They connect and transmit force from muscle to bone and bone to bone, respectively. Both tissues are able to store elastic energy and withstand high tensile forces, on which locomotion is entirely dependent. T/L are predominantly composed of collagen type I fibrils organized in a highly hierarchical manner that is unique for the T/L. Other collagens (types XI, XII, XIV, and XV) and various proteoglycans (decorin, cartilage oligomeric matrix protein (COMP), byglican, lumican, fibromodulin, tenascin-C, etc.) are building the remaining T/L substance. The cellular content of T/L is dominated by tendon-specific fibroblasts named tenocytes. During embryonic development, the tendon-specific cells descend from a sub-set of mesenchymal progenitors condensed in the syndetome, a dorsolateral domain of the sclerotome. Moreover, Mesenchymal stem cells (MSCs), multipotent adult cells that give rise to tissues of mesodermal origin, have been shown to generate in vitro T/L progenitor cells. Several tendon injuries result from gradual wear and tear to the tendon from overuse or aging. Tendon healing is a complex and highly-regulated process that is initiated, sustained and eventually terminated by a large number and variety of molecules. Growth factors represent one of the most important molecule families involved in regeneration. The activity of five growth factors has been best characterized during this process: insulin-like growth factor-I (IGF-I), transforming growth factor beta (TGFbeta), vascular endothelial growth factor (VEGF), platelet-derived growth factor (PDGF), and basic fibroblast growth factor (bFGF). Stimulating the differentiation of MSCs and/or inducing growth factor activity thus represent two potentially significant therapeutic targets in T/L regeneration and healing.

Fertility and Reproduction

Reproduction (or procreation) is the biological process by which new offspring individual organisms are produced from their parents. Sexual reproduction is a biological process by which organisms create descendants that have a combination of genetic material contributed from two (usually) different members of the species. Fertility is the natural capability to produce offspring. The development and physiological functions of basic structures in the mammalian reproductive system are influenced by the tissue-specific expression of members of different growth factors families like the BMP family. The establishment of the germ line is a fundamental aspect of reproduction. Germ cell determination is induced in epiblast cells by the extraembryonic ectoderm, and is not acquired through the inheritance of preformed germ plasma. There is some strong evidence that BMP-4 and -8b play a central role in determining primordial germ cell (PGC) formation in the embryo. The genes encoding BMP-4 and -8b have overlapping expression in the extraembryonic ectoderm before gastrulation, i.e., before PGCs are seen. Thus, PGC formation requires BMP-4 expression. There is also evidence from knockout mammals that BMP-8b is required for PGC formation. Furthermore, there is increasing evidence that locally produced BMPs play a major role in the differentiation of the pituitary gonadotrope. Restoring the BMPs signaling would thus be an important factor in infertility therapies.

Hair

Tissue homeostasis and regeneration are regulated through balancing quiescence and activation of quiescent epithelial stem cells (SCs). Hair follicles (HFs) follow this process. Throughout adult life, they undergo dynamic, synchronized cycles of degeneration (catagen), quiescence (telogen), and regeneration (anagen). During telogen, which can last for months, HFSCs are quiescent and reside within a specialized microenvironment called the bulge. Within this niche, HFSCs surround the hair shaft produced in the previous cycle. Throughout telogen, the base of the bulge, called the secondary hair germ (HG), directly abuts the underlying mesenchymal dermal papillae (DP), a key signaling center for HFSCs. The telogen/anagen transition relies upon DP-HFSC crosstalk to generate the necessary threshold of activating factors. Upon activation, HFSCs in the HG are the first to proliferate and initiate HF regeneration, whereas HFSCs within the bulge become active several days later. As the new HF emerges, the DP stimulus is pushed increasingly further from niche SCs, which return to quiescence. In contrast, throughout anagen, relatively undifferentiated bulge cell progeny along the outer root sheath (ORS) accelerate proliferation as they approach the DP. This fuels a steady production of transiently amplifying matrix cells, which undergo a few divisions while in contact with DP and then terminally differentiate to form the hair and inner root sheath (IRS). At the anagen/catagen transition, matrix cells apoptosis and the DP retracts upward along with the dying/differentiating epithelial strand. As the HF reenters telogen, growth factors from the inner layer of non-SC niche cells and from surrounding dermal tissue impose a threshold, which must be overcome to initiate the next cycle. When cells in the telogen phase are not able to reenter into the anagen phase, hair stop their growth, and conditions such as hair loss emerge. As a result, acting on the differentiation cycle of mammal hair follicle mesenchymal stem cells and precursor cells may have applications in hair follicle tissue regeneration thus preventing hair-loss and activating hair-growth, preventing/treating alopecia areata, alopecia totalis, alopecia universalis, androgenic alopecia (male pattern baldness), telogen effluvium, anagen effluvium or chemotherapy-induced alopecia, but is not limited.

Skin

The skin constantly renews itself throughout adult life. Stem cells (SCs) residing in the epidermis ensure the maintenance of adult skin homeostasis, but they also participate in the repair of the epidermis after injuries. The skin protects the body from dehydration, injury and infection. The skin consists of an underlying dermis, separated by a basement membrane from the multilayered overlaying epidermis. The dermis is of mesodermal embryonic origin and contains as adult stem cells fibroblastic mesenchymal stem-cell-like cells. These cells have a multi-lineage differentiation potential, being also able to form adipose tissue or bones. The stratified epidermis is of ectodermal origin and composed of keratinocytes that differentiate to a water-impermeable stratum corneum. The terminally differentiated cells in the epidermis are shed from the skin, necessitating a continuous delivery of newly differentiating cells. The epidermis is completely renewed about every four weeks. Given that the differentiated cells cannot divide anymore, their replacement depends on epidermal stem cells. Skin stem cells are of special interest because they are easily accessible. In recent years, several products said to have a link with skin stem cells have found their way to the cosmetic products market such as AMATOKIN®, a face care product line commercialised by Voss Laboratories and said to stimulate stem cells in the skin, or Dior's CAPTURE® R60/80 XP product line used as anti-wrinkles whose mechanism is said to be based on the protection of the life force of stem cells. As a result, there is thus some potential in acting on the differentiation cycle of mammal skin mesenchymal stem cells and precursor cells with potential applications in skin tissue regeneration thus preventing wrinkles formation and generally improving skin appearance.

Blood

Blood is a bodily fluid in animals that delivers necessary substances such as nutrients and oxygen to the cells and transports metabolic waste products away from those cells. When it reaches the lungs, gas exchange occurs wherein carbon dioxide is diffused out of the blood into the alveoli and oxygen is diffused into the blood. This oxygenated blood is pumped to the left hand side of the heart in the pulmonary vein and enters the left atrium. From here it passes through the bicuspid valve, through the ventricle and taken all around the body by the aorta. Blood contains antibodies, nutrients, oxygen and much more to help the body work. In vertebrates, it is composed of blood cells suspended in blood plasma. Plasma, which constitutes 55% of blood fluid, is mostly water (92% by volume), and contains dissipated proteins, glucose, mineral ions, hormones, carbon dioxide (plasma being the main medium for excretory product transportation), and blood cells themselves. Albumin is the main protein in plasma, and it functions to regulate the colloidal osmotic pressure of blood. Hematopoietic stem cells (HSCs) are the blood cells that give rise to all the other blood cells and are derived from the mesoderm. They are located in the red bone marrow, which is contained in the core of most bones. The HSCs give rise to the myeloid lineage (monocytes and macrophages, neutrophils, basophils, eosinophils, erythrocytes, megakaryocytes/platelets, dendritic cells), and to the lymphoid lineages (T-cells, B-cells, NK-cells). The most abundant cells in the vertebrate blood are red blood cells (also called RBSs or erythrocytes). These contain hemoglobin, an iron-containing protein, which facilitates oxygen transport by reversibly binding to this respiratory gas and greatly increasing its solubility in blood. Blood cell degeneration-related diseases, conditions or disorders include, but are not limited to, Anemia, Iron-deficiency anemia, Anemia of chronic disease, Pernicious anemia, Aplastic anemia, Autoimmune hemolytic anemia, Thalassemia, Sickle cell anemia, Polycythemia vera, Vitamin deficiency anemia, Hemolytic anemia, Thrombocytopenia, Idiopathic thrombocytopenic purpura, Heparin-induced thrombocytopenia, Thrombotic thrombocytopenic purpura, Essential thrombocytosis (primary thrombocythemia), Thrombosis, Hemophilia, von Willebrand disease, Hypercoaguable state (hypercoagulable state), Deep venous thrombosis, Disseminated intravascular coagulation (DIC), Thrombocytopenia, Immune Thrombocytopenia (ITP), Drug-induced thrombocytopenia (DITP), Gestational thrombocytopenia, Thrombotic microangiopathies (TMA), Drug-induced thrombotic microangiopathies, Complement-mediated thrombotic microangiopathies, Mixed cryoglobulinemia, Eosinophilia, Eosinopenia, Idiopathic hypereosinophilic syndrome, Antiphospholipid syndrome (Hughes syndrome), Glanzmann's thrombasthenia, Wiskott-Aldrich syndrome (WAS), Leishmania infection, Toxoplasmosis, Hereditary hypogammaglobulinemia, Non-familial hypogammaglobulinemia, Leukopenia, Agranulocytosis, Basopenia, Bernard-Soulier syndrome (BSS), Malaria, Sepsis, or Hemolytic uremic syndrome (HUS).

Adipose Tissue

Adipose tissue is loose connective tissue composed mostly of adipocytes. In addition to adipocytes, adipose tissue contains the stromal vascular fraction (SVF) of cells including preadipocytes, fibroblasts, vascular endothelial cells and a variety of immune cells (i.e. adipose tissue macrophages (ATMs)). Adipose tissue is derived from pre-adipocytes. Its main role is to store energy in the form of lipids, although it also cushions and insulates the body. Pre-adipocytes are thought to be undifferentiated fibroblasts that can be stimulated to form adipocytes. The pre-adipocytes originate from mesenchymal stem cells. Areolar connective tissue is composed of adipocytes. The term "lipoblast" is used to describe the precursor of the adult cell. Adipose tissue degeneration-related diseases, conditions or disorders include, but are not limited to, Obesity, Dercum's disease (DD), Multiple symmetric lipomatosis (MSL), Familial multiple lipomatosis (FML), Lipodystrophy, Lipedema, or Atherosclerosis.

Lung

The lung is the essential respiration organ in many air-breathing animals. In mammals the two lungs are located near the backbone on either side of the heart. Their principal function is to transport oxygen from the atmosphere into the bloodstream, and to release carbon dioxide from the bloodstream into the atmosphere. A large surface area is needed for this exchange of gases, which is accomplished by the mosaic of specialized cells that form millions of tiny, exceptionally thin-walled air sacs called alveoli. Lung cells include, but are not limited to, type I pneumocytes, type II pneumocytes, clara cells and goblet cells. Lung tissue degeneration-related diseases, conditions or disorders include, but are not limited to, Asthma, Chronic obstructive pulmonary disease (COPD), Chronic bronchitis, Emphysema, Cystic fibrosis, Pulmonary edema, Acute respiratory distress syndrome (ARDS), Pneumoconiosis, Interstitial lung disease (ILD), Sarcoidosis, Idiopathic pulmonary fibrosis, Pulmonary embolism (PE), Pulmonary hypertension, Pleural effusion, Pneumothorax, Mesothelioma, Granulomatosis with polyangiitis (GPA), Goodpasture syndrome (GPS), Pulmonary hyperplasia, Infant respiratory distress syndrome (IRDS), Chronic obstructive pulmonary disease (COPD), Silicosis, Sleep Apnea, Severe Acute Respiratory Syndrome (SARS), Pulmonary fibrosis, Primary ciliary dyskinesia (PCD), Pneumoconiosis (Black Lung Disease), Hypersensitivity Pneumonitis, Cryptogenic Organizing Pneumonia (Bronchiolitis Obliterans Organizing Pneumonia (BOOP)), Byssinosis, Bronchopulmonary Dysplasia, Bronchiolitis, Bronchiectasis, Asbestosis, Pertussis, Middle Eastern Respiratory Syndrome (MERS), Pneumonia, Tuberculosis, Bronchitis, Histoplasmosis, Coccidioidomycosis (Cocci), or Acute bronchitis.

The present invention thus provides compounds, compositions, microenvironments, functionalised bioactive carriers, medical devices, kits, methods and processes for the design, preparation, manufacture and/or formulation of such compounds, compositions, functionalised bioactive carriers, medical devices and kits, and methods and uses thereof for regenerating or recoding mammalian tissues.

BRIEF DESCRIPTION OF THE DRAWINGS

FIG. 9 is a representation of the commitment of human Bone Marrow Mesenchymal Stem Cells towards osteoblast-like cells after 48 hours of culture on collagen and on apatite ceramics coated with osteogenic GFR-binding compounds as described herein using Runx2 and Osterix immunofluorescent stainings (a). (b) is an analysis for Alkaline Phosphatase Activity.

FIG. 10 is a representation of an immunofluorescent staining of F-actin (green) and Osteopontin (red) for hMSC showing their differentiation into osteoblast cells after 96 hours of culture on a type-I collagen scaffold non-covalently modified with GFR-binding compounds as described herein.

FIG. 15 is (a) Phase-contrast Micrograph showing the progression of migrating cells after scratching. (b) Mean epithelial cell velocity measured for cells cultured on a native polymer or on a polymer covalently modified with GFR-binding compounds as described herein.

Figure 20:
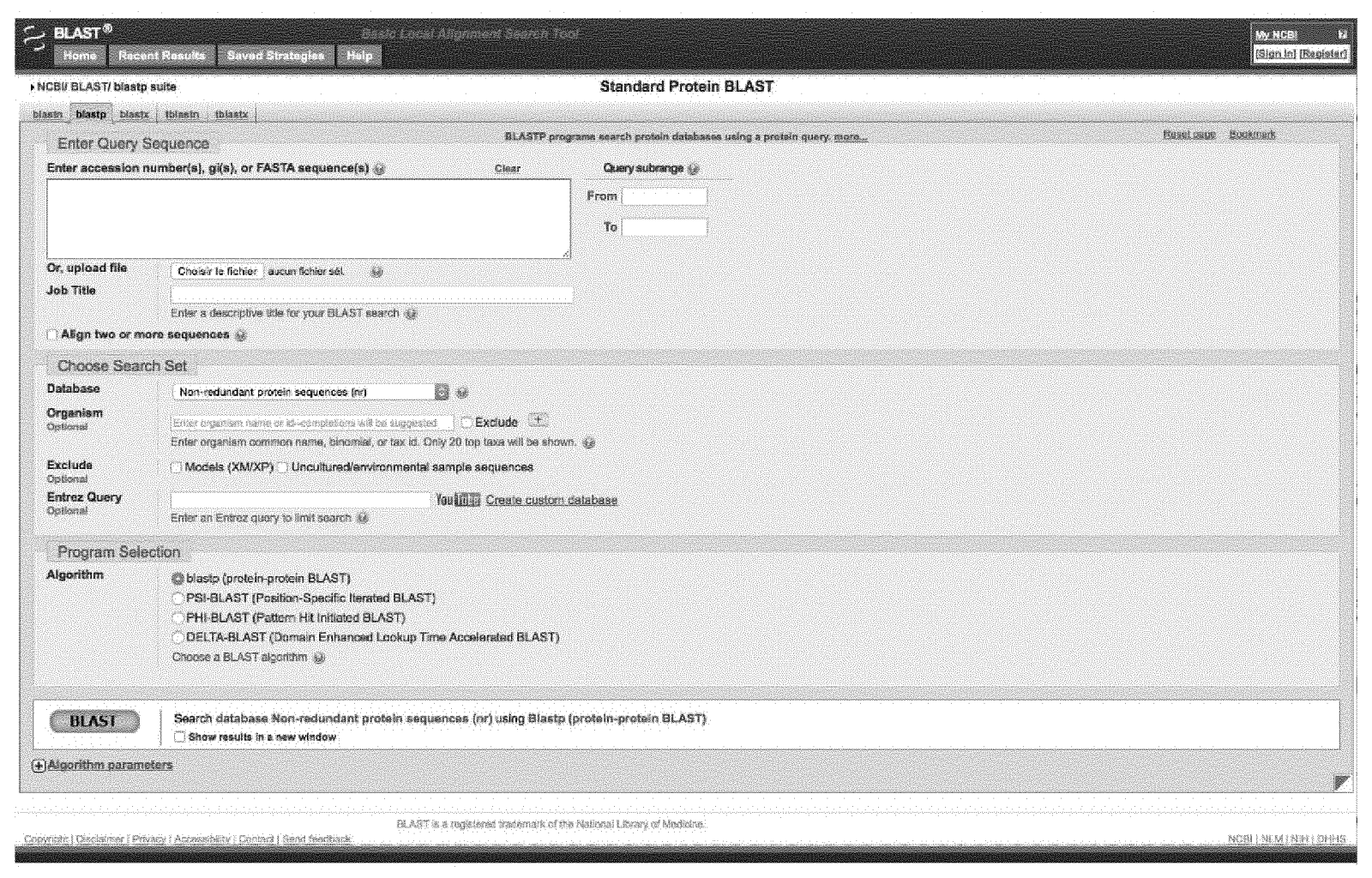

FIG. 20 is a screen shot of the Standard Protein Blast online software used in the RMSD calculation procedure.

FIG. 23 is a histological analysis of coronal sections of the femoral defect sites for or representative GFR-binding compound of the present disclosure condition as compared to the Control 2 condition, 3 weeks (A) and 12 weeks (B) after implantation in the critical size induced defect. 3 types of stainings were performed on the sections: Haematoxylin and Eosin staining (HE) to qualitatively analyze tissue morphology; Tartrate-Resistant Acid Phosphatase (TRAP) staining to highlight the active osteoclasts (red) fraction inside bone tissue (light blue); Von Kossa and Van Gieson (VKVG) staining to highlight mineralized bone tissue (black), non mineralized osteoid tissue (dark pink) and fibrous tissue (light pink). The discontinuous lines on the HE staining indicate the approximate defect site area. Light green stars indicate the ceramics. Black residues in the TRAP staining correspond to calcified ceramic crystals.

DETAILED DESCRIPTION

Figure 1:
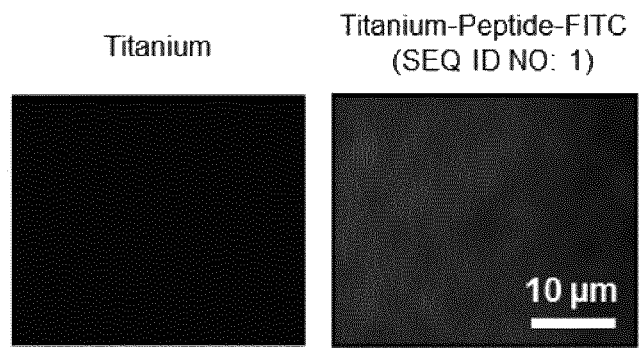
FIG. 1 is a diagram representing a fluorescence intensity of certain embodiments of the invention covalently grafted onto a titanium surface.

Cellular differentiation is the process by which a cell type becomes specialized, and involves a highly controlled switch from one gene expression pattern to another. In each specific lineage, cells progress through various stages of differentiation and maturation. In the case of bone lineage, osteoblast progenitors are derived from adult bone marrow mesenchymal stem cells, followed by osteoblast precursors, mature osteoblasts and osteocytes.

Mesenchymal stem cells or MSCs are multipotent stromal cells that can differentiate into a variety of cell types including osteoblasts (bone cells), chondrocytes (cartilage cells), neurons, endothelial cells and adipocytes (fat cells). Growth factors generally modulate MSC activity through non-covalent binding to specific receptors called growth factor receptors (GFRs). Growth factors (GF) bind to serine-threonine kinase receptors on the cell surface, triggering specific intracellular pathways that activate and influence gene transcription, having effects in cell proliferation and/or differentiation. There are three or more receptors (types I, II and III) for GF members but only types I and II are required for binding and signalling. After binding of signal molecule, receptors are activated which leads into induction of SMAD pathway. Type I receptors phosphorylate receptor-regulated Smads (R-Smads) which form a complex with common-partner Smad (Co-Smad). This complex is translocated into the nucleus and modulates gene transcription with other transcription factors required for chondrogenic differentiation.

Modulation of such an activity may typically be performed using recombinant growth factors. However, studies indicated that prior attempts using this technology, for instance, in the field of spinal fusion, may be harmful to the patient treated and lead in certain cases to the development of tumors and other serious side-effects. The real clinical advantage over previously employed technics not involving the use of recombinant growth factors may also be questioned.

Other attempts to induce tissue formation involve the use of synthetic peptides reproducing parts of the natural sequences of growth factors. For example, these synthetic peptides have been studied for their potential use in improving bone repair. However, these peptides generally often lack sufficient biological activity and suffer from poor in-vitro and/or in-vivo stability. Furthermore, the tissue-induction activity of conventional synthetic peptides is not rapid. For example, in-vitro osteogenic differentiation of mesenchymal stem cells cultured on biomaterials using such conventional peptides is generally observed after 3 weeks of cell culture.

The present invention thus provides embodiments for:
- Modifying and/or enhancing and/or modulating and/or promoting and/or activating tissue regeneration in mammals, preferably humans;
- Modifying and/or enhancing and/or modulating and/or promoting and/or activating bone, and/or cartilage, and/or vascular, and/or neuronal, and/or retinal, and/or organs such as kidneys or lungs, and/or ligament/tendon, and/or hair follicle, and/or skin, and/or blood, and/or adipose, tissue regeneration;
- Modifying and/or enhancing and/or modulating and/or promoting and/or activating embryonic patterning;
- Modifying and/or enhancing and/or modulating and/or promoting and/or activating cellular migration and wound healing;
- Modifying and/or enhancing and/or modulating and/or promoting and/or activating the closure of any type of living tissues;
- Modifying and/or enhancing and/or modulating and/or promoting and/or activating female fertility;
- Preventing and/or suppressing or avoiding or reducing tissue degeneration in mammals, preferably humans;
- Preventing and/or suppressing or avoiding or reducing bone, and/or cartilage, and/or vascular, and/or neuronal, and/or retinal, and/or organs such as kidneys or lungs, and/or ligament/tendon, and/or hair follicle, and/or skin, and/or blood, and/or adipose, tissue degeneration;
- Protecting a subject from a tissue degeneration disease, disorder or condition;
- Protecting a subject from osteoporosis;
- Preventing and/or suppressing or avoiding or reducing cellular immobilization and wound formation and/or progression;
- Preventing and/or suppressing or avoiding or reducing the misclosure of any type of living tissue;
- Preventing and/or suppressing or avoiding or reducing female infertility;

Preventing and/or suppressing or avoiding or reducing hair-loss;

Preventing/treating alopecia areata, alopecia totalis, alopecia universalis, androgenic alopecia (male pattern baldness), telogen effluvium, anagen effluvium or chemotherapy-induced alopecia, Modifying and/or enhancing and/or modulating and/or promoting and/or activating the osteogenicity, and/or the chondrogenecity, and/or the endothelization and vascularization ability, and/or hair growth ability, and/or the wound healing ability, and/or the skin repair ability, and/or the tissue defect closure ability, and/or the neuroregeneration ability, and/or the ligament/tendon tissue regeneration ability, and/or the female fertility ability, of a bioactive carrier such as a biomaterial which may be useful in the manufacturing of medical devices;

Modifying and/or enhancing and/or activating anti-aging/anti-wrinkle effects/properties in cosmetic products;

Modifying and/or enhancing and/or activating hair growth effects/properties in cosmetic products;

Modifying and/or enhancing and/or modulating and/or promoting and/or inducing and/or activating stem cells, preferably adult stem cells, more preferably mesenchymal stem cells, commitment and/or differentiation in a specific lineage of cells;

Modifying and/or enhancing and/or modulating and/or promoting and/or inducing and/or activating progenitor cells differentiation and/or maturation;

Obtaining/producing functional differentiated cells;

Obtaining/producing differentiated cells with modified and/or improved functionality and/or physiological activity.

I. Definitions

Those skilled in the art will recognize, or be able to ascertain using no more than routine experimentation, many equivalents to the specific embodiments in accordance with the invention described herein. The scope of the present invention is not intended to be limited to the present description, but rather is as set forth in the appended claims.

In the claims, articles such as "a", "an", and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the terms "consisting of", "consisting essentially of", "consisting substantially of" and "consisting exclusively of" are thus also encompassed and disclosed.

As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise indicated, self-evident or contradictory in context (e.g. except where such number would exceed 100% of a possible value).

As used herein and unless otherwise indicated or contradictory in context, the term "with" followed by a specific number of amino acids, when used to define a particular peptide, variant or analog thereof, such as in "a peptide with three amino acids", means that such peptide, variant or analog thereof, contains exclusively the specific number of amino acids specified after this term.

As used herein and unless otherwise indicated or contradictory in context, the term "Ci-alkyl" is intended to specifically and individually disclose any branched or unbranched radical, moiety or functional group having "i" carbon atom(s).

The carbon atom content of the various hydrocarbon-containing moieties herein may be indicated by a prefix designating the minimum and maximum number of carbon atoms in the moiety. For example, in certain embodiments, (Ca-Cb)alkyl indicates an alkyl moiety of the integer "a" to the integer "b" carbon atoms, inclusive.

At various places in the present specification, substituents of compounds of the present disclosure may be disclosed in groups or in ranges. It is specifically intended that the present disclosure include each and every individual sub-combination of the members of such groups and ranges. For example, in certain embodiments, the term "C1-C5 alkyl" is an abbreviation for (and thus is specifically intended to individually disclose) C1-alkyl (i.e. methyl), C2-alkyl (i.e. ethyl), C3-alkyl (i.e. 1-propyl and 2-propyl), C4-alkyl (i.e. 1-butyl, sec-butyl, iso-butyl and tert-butyl), and C5-alkyl (i.e. 1-pentyl, 2-pentyl, 3-pentyl, 2-methyl-1-butyl, 3-methyl-1-butyl, 2-methyl-2-butyl, 3-methyl-2-butyl, 2,2-dimethyl-1-propyl and 1,1-dimethyl-1-propyl).

As used herein, unless indicated otherwise or contradictory in context, the terms "alkyl" and "(Ca-Cb)alkyl" refer to monovalent hydrocarbon radicals containing the requisite number of carbon atoms as described above, having straight or branched moieties or combinations thereof. As used herein, alkyl groups may be optionally substituted with between one to four substitutes. Non-limiting examples of alkyl groups include, e.g. methyl, ethyl, n-propyl, isopropyl, n-butyl, isobutyl, sec-butyl, t-butyl, etc. Of course, other alkyl groups will be readily apparent to those of skilled in the art given the benefit of the present disclosure.

Where ranges are given, endpoints are included. Furthermore, it is to be understood that unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise. For example, in certain embodiments, a disclosed 0-10 range would, for example, in certain embodiments, also specifically and individually disclose the following values and ranges: 0, 1, 2, 3, 4, 5, 6, 7, 8, 9, 10, 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 0-1, 0-2, 0-3, 0-4, 0-5, 0-6, 0-7, 0-8, 0-9, 1-2, 1-3, 1-4, 1-5, 1-6, 1-7, 1-8, 1-9, 2-3, 2-4, 2-5, 2-6, 2-7, 2-8, 2-9, 2-10, 3-4, 3-5, 3-6, 3-7, 3-8, 3-9, 3-10, 4-5, 4-6, 4-7, 4-8, 4-9, 4-10, 5-6, 5-7, 5-8, 5-9, 5-10, 6-7, 6-8, 6-9, 6-10, 7-8, 7-9, 7-10, 8-9, 8-10, 9-10, 0-0.1, 0-0.2, 0-0.3, 0-0.4, 0-0.5, 0-0.6, 0-0.7, 0-0.8, 0-0.9, 0-1.1, 0-1.2, etc.

As used herein and unless otherwise indicated or contradictory in context, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

In addition, it is to be understood that any particular embodiment of the present invention that falls within the prior art may be explicitly excluded from any one or more of the claims using the appropriate disclaimer(s) or proviso(s). Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, in certain embodiments, references, publications, databases, database entries, and art cited herein, are incorporated into this application by reference in their entirety, even if not expressly stated in the citation. In case of conflicting statements of a cited source and the instant application, the statement in the instant application shall control.

As the case may be, and unless otherwise indicated or contradictory in context, macromolecules molecular weights should be understood in the present description as being number averaged molecular weights.

The peptides mentioned in the present description may not follow the usual representation conventions. For instance, the N-terminal amino acid of a peptide sequence may be the first amino acid in the sequence or the last amino acid. Likewise, the C-terminal amino acid of a peptide sequence may be the first amino acid in the sequence or the last amino acid. For example, in the peptide sequence NAIS (SEQ ID NO: 6357), "N" may be N-terminal or C-terminal, and "S" may be N-terminal or C-terminal. Consequently, for the purpose of the present disclosure, e.g. NAIS (SEQ ID NO: 6357) also covers SIAN (SEQ ID NO: 6607), SAIS (SEQ ID NO: 6360) also covers SIAS (SEQ ID NO: 6608), SPIN (SEQ ID NO: 6363) also covers NIPS (SEQ ID NO: 6609), etc.

In the present application, when reference is made to a certain peptide (e.g. a GFR-binding compound as provided herein) comprising one or more other peptide(s), said one or more other peptide(s) is(are) understood to be stably (in most cases, covalently) attached/bound to at least one part of said peptide. The attachment/binding may be located anywhere on the peptide unless indicated otherwise, contradictory in context or contradictory to general scientific rules. No specific attachment/binding location of said one or more other peptide(s) to said peptide shall be assumed unless specifically mentioned.

Peptide or polypeptide: As used herein, the term "peptide" or "polypeptide" are used interchangeably and refers to a polymer of less than or equal to 100 amino acids long, e.g., about 4, 5, 10, 15, 20, 25, 30, 35, 40, 45, 50, 55, 60, 65, 70, 75, 80, 85, 90, 95 or 100 amino acids long. The terms apply to amino acid polymers in which one or more amino acid residue is an artificial chemical mimetic of a corresponding naturally occurring amino acid, as well as to naturally occurring amino acid polymers, non-naturally occurring amino acid polymers, peptide analogs, peptide variants and peptide mimetics. Conventional techniques for synthesising peptides involve the activation of the carboxylic acid function of an amino acid or of a peptide, using a coupling agent. This activated acid is then contacted with an amino acid or a peptide in which the N-terminal amino acid is not protected, thus forming an amide bond also called peptide bond. Coupling reaction conditions together with coupling agents are well known in the art and described, for instance, in Greene, "Protective Groups in Organic Synthesis", Wiley, New York, 2007 4th edition. In addition, suitable peptide synthesis routes are described, for instance, in Hojo H., Recent progress in the chemical synthesis of proteins, Curr Opin Struct Biol. 2014; 26C:16-23 and Saranya Chandrudu, et al., Chemical Methods for Peptide and Protein Production, Molecules, 2013, 18, 4373-4388, each of which is incorporated herein by reference in its entirety. There are two main strategies for peptide synthesis i.e. liquid-phase peptide synthesis and solid-phase peptide synthesis (SPPS) which is now most commonly used for peptide synthesis. Instead of C-terminal protection with a chemical group, the C-terminus of the first amino acid is coupled to an activated solid support, such as polystyrene or polyacrylamide. This type of approach has a two-fold function: the resin acts as the C-terminal protecting group and provides a rapid method to separate the growing peptide product from the different reaction mixtures during synthesis. As with many different biological manufacturing processes, peptide synthesizers have been developed for automation and high-throughput peptide production. SPPS allows the synthesis of natural peptides which are difficult to express in bacteria, the incorporation of unnatural amino acids, peptide/protein backbone modification, and the synthesis of D-proteins, which consist of D-amino acids. Very long peptide can be accessed by using native chemical ligation to couple two peptides together with quantitative yields.

Peptide analogs: As used herein, unless indicated otherwise or contradictory in context, the term "peptide analogs" refers to polypeptide variants which differ by one or more amino acid alterations, e.g., substitutions, additions or deletions of amino acid residues that still maintain one or more of the properties of the parent or starting peptide.

Peptide variants: As used herein, unless indicated otherwise or contradictory in context, the term "peptide variants" refers to a peptide which has a certain identity with a native or reference compound sequence. In one example, the peptide variant refers to any post-administration, application, injection modified peptide. Such post-administration, application, injection modifications include, but are not limited to, phosphorylation, acetylation, glutamylation, tyrosination, palmitoylation, glycosylation, myristoylation, palmitoylation, isoprenylation, glypiation, lipoylation, phosphopantetheinylation, acylation, alkylation, amidation, arginylation, polyglutamylation, polyglycylation, butyrylation, gamma-carboxylation, glycosylation, polysialylation, malonylation, hydroxylation, iodination, nucleotide addition, oxidation, adenylylation, propionylation, pyroglutamate formation, S-glutathionylation, S-nitrosylation, succinylation, sulfation, glycation, biotinylation, pegylation, ISGylation, SUMOylation, ubiquitination, Neddylation, Pupylation, citrullination, deamidation, eliminylation, carbamylation, and racemization.

Peptido-mimetic: As used herein, unless indicated otherwise or contradictory in context, the term "peptido-mimetic" or "peptidomimetic" refers to a synthetic chemical compound which comprises amino acids but not only and that is able to mimic the biological action of a peptide, often because the mimetic has a basic structure that mimics the basic structure of the peptide and/or has the salient biological properties of that peptide. In one particular example, a peptidomimetic is a hybrid molecule containing both, at least one peptide, and at least one of a polysaccharide, a polynucleotide or a linear or branched, saturated or unsaturated, hydrocarbon chain.

Linear peptide: As used herein, unless indicated otherwise or contradictory in context, the term "linear peptide" means a peptide in which the C-terminal and the N-terminal amino acid residues do not covalently interact with each other and none of the C-terminal or the N-terminal amino acid residues covalently interacts with another amino acid residue of the peptide chain.

Cyclic peptide: As used herein, unless indicated otherwise or contradictory in context, the term "cyclic peptide" means peptide in which the C-terminal and N-terminal amino acid residues do covalently interact with each other or the C-terminal and/or the N-terminal amino acid residues covalently interact with at least one other amino acid residue of the peptide chain so as to form a ring-like structure.

Amino acid: As used herein, unless indicated otherwise or contradictory in context, the term "amino acid" refers to naturally occurring and non-naturally occurring amino acids including amino acid analogs. Naturally occurring amino acids are those encoded by the genetic code, as well as those amino acids that are later modified, e.g., hydroxyproline, [gamma]-carboxyglutamate, and O-phosphoserine. Naturally encoded amino acids are the 20 common amino acids glycine (Gly, G), alanine (Ala, A), valine (Val, V), leucine (Leu, L), isoleucine (Ile, I), serine (Ser, S), threonine (Thr, T), phenylalanine (Phe, F), tyrosine (Tyr, Y), tryptophane (Trp, W), cysteine (Cys, C), methionine (Met, M), proline (Pro, P), aspartic acid (Asp, D), asparagine (Asn, N), glutamine (Gln, Q), glutamic acid (Glu, E), histidine (His, H), arginine (Arg, R) et lysine (Lys, K) and pyrrolysine and selenocysteine. Non-naturally occurring amino acids include, but are not limited to, the dextrogyre (D) isomers of the above-cited naturally-occurring amino acids. Amino acid analogs refers to compounds that have the same basic chemical structure as a naturally occurring amino acid i.e., an [alpha] carbon that is bound to a hydrogen, a carboxyl group, an amino group, and an R group (i.e. side chain), and which may be used in replacement thereof without substantially affecting the overall function of the peptide to which it belongs. Amino acid analogs (or non-naturally occurring amino acids) that may be suitable for implementing embodiments of the present invention include, but are not limited to, amino acids comprising a photoactivatable cross-linker, spin-labeled amino acids, fluorescent amino acids, metal binding amino acids, metal-containing amino acids, radioactive amino acids, amino acids with novel functional groups, amino acids that covalently or noncovalently interact with other molecules, photocaged and/or photoisomerizable amino acids, amino acids comprising biotin or a biotin analogue, glycosylated amino acids such as a sugar substituted serine, other carbohydrate modified amino acids, keto-containing amino acids, amino acids comprising polyethylene glycol or polyether, heavy atom substituted amino acids, chemically cleavable and/or photocleavable amino acids, amino acids with an elongated side chains as compared to natural amino acids, including but not limited to, polyethers or long chain hydrocarbons, including but not limited to, greater than about 5 or greater than about 10 carbons, carbon-linked sugar-containing amino acids, redox-active amino acids, amino thioacid containing amino acids, and amino acids comprising one or more toxic moiety. The term "$AA^I$" (AA roman numeral one) may be used in the description and refers to an amino acid which may be any amino acid as defined above in particular any naturally occurring and non-naturally occurring amino acids.

Amino acid side chain: As used herein, unless indicated otherwise or contradictory in context, the term "amino acid side chain" means the functional group of an amino acid that differentiates it from other amino acids. All amino acid structures have a carboxyl group, an amine group and a specific side chain.

$AA^{II}$ (AA roman numeral two): As used herein, unless indicated otherwise or contradictory in context, the terms "polar amino acid" or "AA" means amino acids having a polar, non-charged group-containing side chain. Polar amino acids are protonated at physiological pH (about 7). Examples of polar amino acids include, but are not limited to, Cys (C), Asn (N), Gln (Q), Ser (S), Thr (T), or Tyr (Y).

$AA^{III}$ (AA roman numeral three): As used herein, unless indicated otherwise or contradictory in context, the terms "acidic amino acid" or "$AA^{IV}$" means amino acids having an acidic group-containing side chain. Acidic amino acid deprotonated forms predominate at physiological pH (about 7). Examples of acidic amino acids include, but are not limited to, Asn (N) and Glu (E).

$AA^{IV}$ (AA roman numeral four): As used herein, unless indicated otherwise or contradictory in context, the terms "aliphatic amino acid" or "$AA^{IV}$" means amino acids having an aliphatic side chain. Examples of aliphatic amino acids include, but are not limited to, Ala (A), Leu (L), Ile (I), Gly (G), Val (V) and any analogs and derivatives thereof.

$AA^V$ (AA roman numeral five): As used herein, unless indicated otherwise or contradictory in context, the terms "apolar amino acid" or "$AA^V$" means amino acids having an apolar side chain. Examples of apolar amino acids include, but are not limited to, Ala (A), Phe (F), Gly (G), Ile (I), Leu (L), Met (M), Pro (P), Val (V) or Trp (W).

$AA^{VI}$ (AA roman numeral six): As used herein, unless indicated otherwise or contradictory in context, the term "aromatic amino acid" or "$AA^{VI}$" means amino acids having an aromatic group-containing side chain. Examples of aromatic amino acids include, but are not limited to, Trp (W), Tyr (Y) or Phe (F).

$AA^{VII}$ (AA roman numeral seven): As used herein, unless indicated otherwise or contradictory in context, the term "basic amino acid" or "$AA^{VII}$" means amino acids having a basic group-containing side chain. Basic amino acid protonated forms predominate at physiological pH (about 7). Examples of basic amino acids include, but are not limited to, Arg (R), His (H), or Lys (K).

$AA^{VIII}$ (AA roman numeral eight): As used herein, unless indicated otherwise or contradictory in context, the term "$AA^{VIII}$" means Leu (L) or Ile (I) and any analogs and derivatives thereof.

$AA^{IX}$ (AA roman numeral nine): As used herein, unless indicated otherwise or contradictory in context, the term "charged amino acid" or "$AA^{IX}$" means amino acids having either an acidic group-containing side chain or an basic group-containing side chain. Charged amino acid charged forms predominate at physiological pH (about 7). Examples of charged amino acids include, but are not limited to, Asn (N), Glu (E), His (H), Lys (K) or Arg (R).

AA$^n$: As used herein, unless indicated otherwise or contradictory in context, the term "AA$^n$", in which n is a positive integer arbitrarily chosen to identify a specific position within the primary sequence of a peptide. For instance, AA$^{13}$ means the amino acid of position 13. The terms "amino acid" and "AA" are interchangeably used in the present description.

N-terminal: As used herein, unless indicated otherwise or contradictory in context, the term "N-terminal" means the amine (—NH$_2$) function/group/moiety located at one (terminal) end of a protein or polypeptide. This functional group is the only amine group which is not engage in n amide peptide bond.

C-terminal: As used herein, unless indicated otherwise or contradictory in context, the term "C-terminal" means the carboxylate (—CO$_2$H) function/group/moiety located at one (terminal) end of a protein or polypeptide. This functional group is the only carboxylic acid group which is not engage in n amide peptide bond.

Naturally-occurring peptide: As used herein, unless indicated otherwise or contradictory in context, the terms "naturally-occurring peptide" or "natural peptide" means a peptide which may be found in nature without human direct intervention (except for its extraction and/or isolation).

Synthetic peptide: As used herein, unless indicated otherwise or contradictory in context, the terms "synthetic peptide" or "non-natural peptide" means a peptide which may not be found in nature without human direct intervention (except for its extraction and/or isolation). For example, in certain embodiments, a synthetic peptide may have the amino acid sequence of a natural peptide except for at least one amino acid deletion or substitution relative to the natural sequence. In the case of a substitution, an amino acid from the natural sequence is replaced by another, different, naturally-occurring or non-naturally occurring amino acid. For example, in certain embodiments, a synthetic peptide may not possess a post-translational modification of the natural peptide such as the attachment of an acetate group, a phosphate group, a lipid, a carbohydrate, or the formation of a disulfide bridge.

Covalent interaction: As used herein, unless indicated otherwise or contradictory in context, the term "interact covalently", "covalent interaction" or "covalent bond" are interchangeably used and means a chemical bond or interaction that involves the sharing of electron pairs between atoms. Examples of such interactions are σ-bonding and π-bonding.

Non-covalent interaction: As used herein, unless indicated otherwise or contradictory in context, the term "interact non-covalently", "non-covalent interaction" or "non-covalent bond" are interchangeably used and means a chemical bond or interaction that does not involve the sharing of electron pairs between atoms but rather involves more dispersed variations of electromagnetic interactions between molecules or within a molecule. Non-covalent interactions can be generally classified into four categories, electrostatic interactions, π-interactions, van der Waals forces, and hydrophobic interactions.

Electrophile: As used herein, unless indicated otherwise or contradictory in context, the term "electrophile" means an organic molecule attracted to electrons that participates in a chemical reaction by accepting an electron pair in order to bond to a nucleophile. Most electrophiles are positively charged, have an atom that carries a partial positive charge, or have an atom that does not have an octet of electrons.

Nucleophile: As used herein, unless indicated otherwise or contradictory in context, the term "nucleophile" means an organic molecule that donates an electron pair to an electrophile to form a chemical bond in relation to a reaction. All molecules or ions with a free pair of electrons or at least one pi bond can act as nucleophiles.

Polysaccharide: As used herein, unless indicated otherwise or contradictory in context, the term "polysaccharide" means polymeric carbohydrate molecules composed of long chains of monosaccharide units bound together by glycosidic linkages and which upon hydrolysis provide monosaccharides or oligosaccharides. They range in structure from linear to highly branched polymers.

Polynucleotide: As used herein, the term "polynucleotide" or "nucleic acid", which are used interchangeably, refers to the phosphate ester polymeric form of ribonucleosides ("RNA molecules") or deoxyribonucleosides ("DNA molecules"), or any phosphoester analogs thereof, such as phosphorothioates and thioesters, in either single stranded form, or a double-stranded helix. The term "nucleic acid" includes double-stranded DNA round, inter alia, in linear (e.g., restriction fragments) or circular DNA molecules. In particular, nucleic acids as used herein refer to nucleic acids such as RNAs encoding for agonist of growth factor receptors as defined herein.

Nucleoside: As used herein, the term "nucleoside" refers to a compound containing a sugar molecule (e.g., a pentose or ribose) or derivative thereof in combination with an organic base (e.g., a purine or pyrimidine) or a derivative thereof (also referred to herein as "nucleobase").

Nucleotide: As used herein, the term "nucleotide" refers to a nucleoside including a phosphate group.

Dendrimer: As used herein, unless indicated otherwise or contradictory in context, the term "dendrimer" means any repetitively branched molecules. Examples of dendrimers are phosphorous dendrimers, polylysine dendrimers, polypropylenimine dendrimers and PAMAM dendrimers, such as the ones described, for instance, in Scientific World Journal. 2013; 2013:732340; Curr Opin Chem Biol. 1998; 2(6):733-42; J Pept Sci. 1999; 5(5):203-20; and J Pept Sci. 2008; 14(1):2-43, which may be used for implementing embodiments of the present invention, each of which being herein incorporated by reference in its entirety.

Synthetic molecule: As used herein, unless indicated otherwise or contradictory in context, the term "synthetic molecule" means a molecule which may not be found in nature without human direct intervention (except for its extraction and/or isolation).

Synthetic polymers: As used herein, unless indicated otherwise or contradictory in context, the term "synthetic polymer" refers to a macromolecule or polymer which may not be found in nature without human direct intervention (except for its extraction and/or isolation).

Biocompatible: As used herein, unless indicated otherwise or contradictory in context, the term "biocompatible" means compatible with living cells, tissues, organs or systems posing little to no risk of injury, toxicity or rejection by the immune system.

Biologically active: As used herein, unless indicated otherwise or contradictory in context, the term "biologically active" refers to a characteristic of any substance that has activity in a biological system and/or organism. For instance, a substance that, when administered to an organism, has a biological effect on that organism, is considered to be biologically active. In particular examples, a compound, substance or pharmaceutical composition of the present disclosure may be considered biologically active even if a portion of the compound, substance or pharmaceutical composition is biologically active or mimics an activity considered biologically relevant.

Stem cells: As used herein, unless indicated otherwise or contradictory in context, the term "stem cell" refers to the term as it is generally understood in the art. For example, in certain embodiments, stem cells, regardless of their source, are cells that are capable of dividing and renewing themselves for long periods, are at least to a degree unspecialized (undifferentiated), and can give rise to (differentiate into) specialized cell types (i.e., they are progenitor or precursor cells for a variety of different, specialized cell types).

Mesenchymal stem cells: As used herein, unless indicated otherwise or contradictory in context, the term "mesenchymal stem cells" generally means multipotent adult stromal cells that can differentiate into a variety of cell types, such as osteoblasts, chondrocytes, and adipocytes.

Stem cell-like: As used herein, unless indicated otherwise or contradictory in context, the term "Stem cell-like" refers to a cell which is not a stem cell by its origin but functions as a stem cell and presents similar characteristics such as, for example, the expression of stemness markers like Stro-1 and/or is multipotent thus has the ability to differentiate into various cell types.

Progenitor cells: As used herein, unless indicated otherwise or contradictory in context, the term "progenitor cells" generally means a biological cell that, like any stem cell, has a tendency to differentiate into a specific type of cell, but is already more specific than a stem cell and is pushed to differentiate into its "target" cell. Stem cells can generally replicate indefinitely, whereas progenitor cells can divide only a limited number of times.

Adult stem cells: As used herein, unless indicated otherwise or contradictory in context, the term "adult stem cells" means undifferentiated cells, found throughout the body after development, that multiply by cell division to replenish dying cells and regenerate damaged tissues. Also known as somatic stem cells, they can be found in juvenile as well as adult animals and human bodies.

Differentiation: As used herein, unless indicated otherwise or contradictory in context, the term "differentiation" refers to the process by which a less specialized cell becomes a more specialized cell type and involves a switch from one gene expression pattern to another.

Differentiated cells: As used herein, unless indicated otherwise or contradictory in context, the term "differentiated cells" generally means any cell of a specific lineage at the exception of cells containing stem cell specific markers.

Non-terminally differentiated: As used herein, unless indicated otherwise or contradictory in context, the term "non-terminally differentiated", when used in relation to a cell, refers to a differentiated cell as defined herein which has not reached its final state of differentiation. For example, in certain embodiments, in the Osteoblast cell lineage, a non-terminally differentiated cell is any differentiated cell of the lineage at the exception of an osteocyte.

Terminally differentiated: As used herein, unless indicated otherwise or contradictory in context, the term "terminally differentiated", when used in relation to a cell, refers to a differentiated cell as defined herein which has reached its final state of differentiation. For example, in certain embodiments, in the Osteoblast cell lineage, a terminally differentiated cell is an osteocyte.

Methods for obtaining stem cells: Methods for obtaining such stem cells and providing initial culture conditions, such as a liquid culture or semi-solid culture medium, are known in the art. The cells are initially expanded in vivo or in vitro, by contacting the source of the stem cells with a suitable reagent that expands or enriches such cells in the tissue source or in culture. Preferably, adult stem cells are isolated from a tissue source and then expanded or enriched in vitro by exposure to a suitable agent. Cells are obtained from an individual by any suitable method for obtaining a cell sample from an animal, including, but not limited, to, collection of bone marrow collection of a bodily fluid (e.g., blood), collection of umbilical cord blood, tissue punch, and tissue dissection, including particularly, but not limited to, any biopsies of skin, intestine, cornea, spinal cord, brain tissue, scalp, stomach, breast, lung (e.g., including lavage and bronchoscopy), fine needle aspirates of the bone marrow, amniotic fluid, placenta and yolk sac.

Osteogenesis: As used herein, unless indicated otherwise or contradictory in context, the term "osteogenesis" refers to the process by which bone is produced. An entity, molecule, compound, association, combination or composition may be said to be "osteogenic" when it has an effect on the development, growth, or repair of bone. This process involves the participation of stem cells.

Chondrogenesis: As used herein, unless indicated otherwise or contradictory in context, the term "chondrogenesis" refers to the process by which cartilage is produced. An entity, molecule, compound, association, combination or composition may be said to be "chondrogenic" when it has an effect on the development, growth, or repair of cartilage. This process involves the participation of stem cells.

Endothelialisation: As used herein, unless indicated otherwise or contradictory in context, the term "endothelialization" or "re-endothelialization" refers to the process that maintains or restores normal vascular homeostasis and regulates neointimal hyperplasia. In native tissue, the endothelium maintains vessel integrity with dynamic mechanisms that prevent thrombosis and intimal hyperplasia. The endothelial progenitor cells are an important component of the response to vascular injury, having the potential to accelerate vascular repair through rapid re-endothelialization. For example, drug-eluting stents are generally implanted during angioplasty into patients suffering from atherosclerosis and resulting in stenosis or restenosis. In drug-eluting stents, the drug is typically coated onto a metal alloy framework and is mainly employed to inhibit neointimal growth (due to proliferation of smooth muscle cells) which would cause restenosis. Because much of the neointimal hyperplasia seems to be caused by inflammation, immunosuppressive and antiproliferative drugs are conventionally used. Drugs such as sirolimus and paclitaxel are currently used. Re-endothelialization in drug-eluting stents is generally delayed which can increase the risk for late stent thrombosis which thus may also require the administration of antiplatelet drugs such as Clopidogrel and aspirin.

Vascularization/angiogenesis: As used herein, unless indicated otherwise or contradictory in context, the term "vascularization/angiogenesis" refers to a physiological process through which new blood vessels are produced from pre-existing vessels. This process involves the participation of stem cells.

Wound healing: As used herein, unless indicated otherwise or contradictory in context, the term "wound healing" refers to a process whereby the skin (or another organ-tissue) repairs itself after injury. This process involves the participation of stem cells.

Skin repair: As used herein, unless indicated otherwise or contradictory in context, the term "skin repair" means the reparation of the dermis through the participation of stem cells. These active cells produce collagenous fibers and ground substance. Blood vessels soon grow into the dermis, restoring circulation.

Neuron-regeneration: As used herein, unless indicated otherwise or contradictory in context, the term "neuron-regeneration" or "neuroregeneration" refers to the regrowth or repair of nervous tissues, cells or cell products involving the participation of stem cells. Such mechanisms may include generation of new neurons, glia, axons, myelin, or synapses.

Tissue closure: As used herein, unless indicated otherwise or contradictory in context, the term "tissue closure" refers to the closure of all tissue layers damaged e.g. in an injury or during surgery. For instance, during bone repair surgery, the different layers of tissues incised in order for the surgeon to reach the damaged bone part and repair it would all need to be closed for the overall healing process to occur.

Cell lineage: As used herein, unless indicated otherwise or contradictory in context, the term "cell lineage" refers to the developmental history of a particular cell from its primary state in the fertilized egg or embryo through to its fully differentiated state. The different steps and phases involved in the development of a cell produces many intermediate cells which may be referred to as progenitor or precursor cells in the present application and form an integral part of the cell lineage.

Osteoblast cell lineage: As used herein, unless indicated otherwise or contradictory in context, the term "osteoblast cell lineage" refers to bone cells at any stage of their development and thus include, but are not limited to, mesenchymal stem cells, osteoblasts, osteocytes or any precursors thereof.

Chondrocytic cell lineage: As used herein, unless indicated otherwise or contradictory in context, the term "chondrocytic cell lineage" refers to cartilage cells at any stage of their development and thus include, but are not limited to, mesenchymal stem cells, Muscle cell lineage: As used herein, unless indicated otherwise or contradictory in context, the term "muscle cell lineage" refers to muscle cells at any stage of their development and thus include, but are not limited to, mesenchymal stem cells, myoblasts, myocytes or any precursors thereof.

Vascular cell lineage: As used herein, unless indicated otherwise or contradictory in context, the term "vascular cell lineage" refers to vascular cells at any stage of their development and thus include, but are not limited to, mesenchymal stem cells, angioblast, pericytes and endothelial cells or any precursors thereof.

Neuronal cell lineage: As used herein, unless indicated otherwise or contradictory in context, the term "neuron lineage" refers to brain cells at any stage of their development and thus include, but are not limited to, neural stem cells, neuroblast, neurocyte and neuroglial cells or any precursors thereof.

Retinal cell lineage: As used herein, unless indicated otherwise or contradictory in context, the term "retinal cell lineage" refers to eye retina cells at any stage of their development and thus include, but are not limited to, photoreceptor, bipolar cells, rod and cone cells or any precursors thereof.

Renal cell lineage: As used herein, unless indicated otherwise or contradictory in context, the term "renal cell lineage" refers to renal cells at any stage of their development and thus include, but are not limited to, mesenchymal stem cells, podocytes, or any precursors thereof.

Ligament and tendon cell lineage: As used herein, unless indicated otherwise or contradictory in context, the term "ligament and tendon cell lineage" or "LIT cell lineage" refers to bone or cartilage cells at any stage of their development and thus include, but are not limited to, mesenchymal stem cells, fibroblasts, fibrocytes, or any precursors thereof.

Fibroblast lineage: As used herein, unless indicated otherwise or contradictory in context, the term "fibroblast lineage" refers to skin cells at any stage of their development and thus include, but are not limited to, mesenchymal stem cells, fibroblasts, keratinocytes, Merkel cells, melanocytes, Langerhans cells, and any precursor cells thereof.

Reproduction system lineage: As used herein, unless indicated otherwise or contradictory in context, the term "reproduction system lineage" refers to Sertoli cells, Leydig cell and Germ cell at any stage of their development, in particular, mesenchymal stem cells.

Blood cell lineages (myeloid lineage and lymphoid lineage): As used herein, unless indicated otherwise or contradictory in context, the term "blood cell lineages" refers to blood cells at any stage of their development from the myeloid or from the lymphoid lineage, and thus include, but are not limited to, hematopoietic stem cells (HSC), myeloid progenitors, lymphoid progenitors, mast cells, myeloblasts, monocytes, macrophages, neutrophils, basophils, eosinophils, erythrocytes, megakaryocytes, thrombocytes, dendritic cells, small lymphocytes, T-lymphocytes (T-cells), B-lymphocytes (B-cells), natural killer (NK)-cells, and any precursor cells thereof.

Adipocyte lineage: As used herein, unless indicated otherwise or contradictory in context, the term "adipocyte cell lineage" refers to adipocyte cells at any stage of their development and thus include, but are not limited to, mesenchymal stem cells, areolar connective cells, adipocytes, pre-adipocytes/lipoblasts, and any precursor cells thereof.

Lung cell Lineages: As used herein, unless indicated otherwise or contradictory in context, the term "lung cell Lineage" refers to lung cells at any stage of their development and thus include, but are not limited to, epithelial cells, erythrocytes, alveolar cells and any precursor cells thereof.

Ratio: As used herein, unless indicated otherwise or contradictory in context, the term "ratio", when used in relation to GFR-binding compound with respect to the bioactive carrier in the pharmaceutical association or composition disclosed herein, refers to the (molar, weight or part as specified) ratio between the quantity of GFR-binding compound and the quantity of bioactive carrier. The ratio may be a molar ratio, a weight ratio or a part ratio and will be specified as needed on a case by case basis. Quantity units may conventionally be mole, millimole, gram, milligram or parts. For example, in certain embodiments, it is convenient to express the relative quantity between GFR-binding compounds and bioactive carriers using densities. It shall be understood that this ratio may be varied according to the cell type to be treated.

Density: As used herein, unless indicated otherwise or contradictory in context, the term "density", when used in relation to GFR-binding compound with respect to the bioactive carrier in the pharmaceutical composition disclosed herein, refers to the quantity of GFR-binding compounds, expressed in e.g. mole, millimole, gram, or milligram, with respect to one standardised surface unit e.g. squared millimetre ($mm^2$), squared micrometre ($\mu m^2$), or squared nanometre ($nm^2$)). For example, in certain embodiments, the ratio between a GFR-binding compound and a bioactive carrier in the pharmaceutical association or composition disclosed herein may be expressed in pmol per mm$^2$ or pmol/mm$^2$.

Recoding: As used herein, unless indicated otherwise or contradictory in context, the term "recoding", when used in relation to a cell (in particular a mesenchymal stem cell or progenitor stem cell), refers to the action of contacting (in-vitro, ex-vivo or in-vivo) a stem cell to be treated with a suitable extracellular micro-environment (e.g. containing a peptide, variant or analog thereof, peptidomimetic, a biomaterial, a medical device, or a medical or cosmetic composition as defined herein) thus providing appropriate extracellular signals so that the cell may undergo efficient differentiation into a more specialised cell type.

Recoding therapy: As used herein, unless indicated otherwise or contradictory in context, the term "recoding therapy" refers to a therapy that promotes efficient stem cell differentiation in an aim to regenerate mammalian tissues.

Extracellular micro-environment: As used herein, unless indicated otherwise or contradictory in context, the term "extracellular micro-environment" refers to the environment surrounding (in functional proximity with) a specific stem cell which is characterized by biophysical, mechanical and biochemical properties specific for each tissue and is able to regulate cell behavior. Modification of the extracellular micro-environment of a specific mesenchymal stem cell using, for instance, a peptide, variant or analog thereof, peptidomimetic, a biomaterial, a medical device, or a medical or cosmetic composition as defined herein, allows for the efficient differentiation of this cell into a more specialised cell type.

Physiologically functional cell: As used herein, unless indicated otherwise or contradictory in context, the term "physiologically functional cell" refers to a cell which is able to perform normally all of the cell functions associated with a particular cell type and necessary for the normal physiology of a cell. These functions include all of the intracellular molecular mechanisms but also all of the activities necessary for a normal communication between the cell and its microenvironment. One method which may be used to verify if a cell is physiologically functional is the grafting of the cell, after the introduction of fluorescent markers, in other mammalian model organisms such as mouse models. The cell is grafted in the tissue corresponding to its cell type. The cell characteristics and normal functions are monitored after a period of time with various methods such as in vivo microscopy or histological staining. The term "functional" when used in relation to a molecule, compound or substance refers to a biological molecule in a form in which it exhibits a property and/or activity by which it is characterized.

Shorter period of time: As used herein, unless indicated otherwise or contradictory in context, the term "shorter period of time", when used in relation to differentiation or recoding duration, means substantially shorter to provide a substantial benefit for the treated patient in comparison with existing treatments. In certain embodiments, a shorter period of time includes at least 1.5-fold, at least 2-fold, at least 2.5-fold, at least 3-fold, at least 3.5-fold, at least 4-fold, at least 4.5-fold, at least 5-fold, at least 6-fold, at least 7-fold, at least 8-fold, at least 9-fold or at least 10-fold reduction with respect to an existing treatment.

Exogenous: As used herein, unless indicated otherwise or contradictory in context, the term "exogenous" refers to a substance coming from outside a living system such as a cell, an organ, or an individual organism. For example, in certain embodiments, exogenous factors in medicine include pathogens and therapeutics. DNA introduced into a cell via transfection or viral infection may be considered as an exogenous factor. Carcinogens are also commonly referred to as exogenous factors.

Endogenous: As used herein, unless indicated otherwise or contradictory in context, the term "endogenous" refers to substances that originate from within an organism, tissue, or cell.

Intracellular: As used herein, unless indicated otherwise or contradictory in context, the term "intracellular" generally means "inside the cell". In vertebrates, such as animals, the cell membrane is the barrier between the inside of the cell and the outside of the cell (the extracellular milieu). Thus, treatments and therapies in which at least one substance, compound, pharmaceutical association, combination or composition penetrates the cell wall of a cell to be treated in order to produce/deliver its (effective) biological effect are considered as intracellular treatments and therapies.

Extracellular: As used herein, unless indicated otherwise or contradictory in context, the term "extracellular" means "outside the cell". In vertebrates, such as animals, the cell membrane is the barrier between the inside of the cell (the intracellular milieu) and the outside of the cell. Thus, treatments and therapies in which no substance, compound, pharmaceutical association, combination or composition requires penetration of the cell membrane in order to produce/deliver its (effective) biological effect (e.g. by interacting with trans-membrane receptors) are considered as extracellular treatments and therapies. In other words, a therapy using a plurality of substances in order to provide the desired biological effect wherein one or more of these substances require the entry into the intracellular compartment to provide (or deliver) its biological effect is not considered as an extracellular therapy in the sense of the present disclosure.

In vitro: As used herein, unless indicated otherwise or contradictory in context, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, unless indicated otherwise or contradictory in context, the term "in vivo" refers to events that occur within an organism (e.g., animal, plant, or microbe or cell or tissue thereof).

Ex vivo: As used herein, unless indicated otherwise or contradictory in context, the term "ex vivo" refers to events that occur in an external environment on tissues sourced from an organism (e.g., animal, plant, or microbe) in an attempt to replicate natural living conditions outside such an organism.

Patient/subject: As used herein, unless indicated otherwise or contradictory in context, the term "patient" or "subject", which are used interchangeably, refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants. As used herein, patients/subjects include those individuals who may seek or be in need of treatment, requires treatment, is receiving treatment, will receive treatment, or a subject who is under care by a trained professional for a particular disease or condition.

Purified: As used herein, unless indicated otherwise or contradictory in context, the term "purify," "purified," "purification" means to make substantially pure or clear from unwanted components, material defilement, admixture or imperfection.

Targeted Cells: As used herein, unless indicated otherwise or contradictory in context, the term "targeted cells" refers to any one or more cells of interest. The cells may be found in vitro, in vivo, in situ or in the tissue or organ of an organism. The organism may be an animal, preferably a mammal, more preferably a human and most preferably a patient.

Molecule length: As used herein, unless indicated otherwise or contradictory in context, the term molecule or peptide "length" or "size" means the longest 2D or 3D distance which may possibly be measured within the molecule. For cyclic molecules, "length" or "size" means the longest measurable distance across the cyclic structure. Throughout the present disclosure, when a molecule size or length is given (in general using the nanometre, nm, unit), the following procedures were used to calculate them:

The so-called «2D» procedure: a 2D chemical structure was drawn in e.g. the ChemDraw® Software. Then, size measurement was carried out via the available ChemDraw length measurement tools. The length value given herein corresponds to the longest 2D length of the molecule using the default settings 2D bond sizes and angles of the software.

Alternatively, the so-called "3D" procedure may be followed:
(1) Drawing of the chemical structure of the molecule using suitable softwares (such as ChemDraw).
(2) Creating a 3D structure model of the molecule hereby drawn using SCWRL (Protein Sci. 2003; 12(9):2001-14) or MODELLER (Current Protocols in Bioinformatics. 15:5.6:5.6.1-5.6.30), each of which is hereby incorporated by reference in its entirety.
(3) Incubating the obtained 3D structure model in a box simulation containing water for few milliseconds using AMBER (J. Computat. Chem. 2005; 26, 1668-1688), which is hereby incorporated by reference in its entirety.
(4) Measuring the size of the molecule hereby obtained using softwares such as Pymol® using available Pymol length measurement tools (DeLano Scientific LLC, www.pymol.org).

Root Mean Square Deviation: As used herein, unless indicated otherwise or contradictory in context, the term "Root Mean Square Deviation" or "RMSD" is well known in the art and means the square root of the arithmetic mean of the square of the distances between certain matched atoms. One can represent a molecular conformation as a vector whose components are the Cartesian coordinates of the molecule's atoms. Therefore, a conformation for a molecule with N atoms can be represented as a 3N-dimensional vector of real numbers. To calculate the RMSD of a pair of peptides or peptidomimetics (e.g. x and y), each one of them must be represented as a 3N-length (assuming N atoms) vector of coordinates. The RMSD is therefore the square root of the arithmetic mean of the square of the distances between corresponding atoms of x and y. It is a measure of the average atomic displacement between the conformations of the two structures:

$$\sqrt{\frac{1}{N}\sum_{i=1}^{N} |xi - yi|1^2}$$

In other words, the RMSD is the measure of the average distance between the atoms (usually the backbone atoms) of superimposed polypeptides or peptidomimetics. In the study of globular protein conformations, one customarily measures the similarity in three-dimensional structure by the RMSD of the Cα atomic coordinates after optimal rigid body superposition.

The RMSD value of a given peptide or peptidomimetic with respect to a specifically selected reference structure (hereinafter may also be referred to as "PEPREF") may be calculated using various methods all well know by the skilled person. However, for the purpose of the present disclosure and for the avoidance of doubts, the RMSD of a given peptide or peptidomimetic as used in the present disclosure is obtained precisely using the following procedure:

STEP 1: Creating a 3-dimensional model of (i.e. obtaining 3D structure coordinates for) a peptide or peptidomimetic for which the RMSD is to be calculated, by:

STEP 1.1: Obtaining a set of polypeptide 3D structure coordinates based on the alignment with the sequence of a peptide or peptidomimetic for which the RMSD value is to be calculated, using the BLAST algorithm according to the following procedure:
1. Open the following link to access the "Standard Protein Blast" tool: blast.ncbi.nlm.nih.gov/Blast.cgi?PROGRAM=blastp&PAGE_TYPE=BlastSearch&LINK_LOC=blasthome
2. Enter the amino acid sequence of the peptide or peptidomimetic of interest in the "Enter Query Sequence" section. The alignment is performed one sequence after the other (this is not a multiple alignment tool).
3. In the section "Choose Search Set", choose the following database: Protein Data Bank Proteins (pdb).
4. In the section "Choose Search Set", do not exclude «Models (XM/XP)» and do not Exclude «Uncultured/environmental sample sequences».
5. In the section "Program Selection", choose the following algorithm: blastp (protein-protein BLAST)
6. Leave other fields as shown on the screenshot in FIG. 20.
7. Run BLAST.
8. The results obtained from the query are presented in the form of several pdb files.
9. From this output results, the first ten (10) PDB files corresponding to the best sequence alignments are retained. This set of 10 PDB files or structures will be used in the next step (Step 2: structural alignments with STAMP).
10. Finally, clean up the 10 structures contained in the 10 PDB files by removing all e.g. additional small molecules, receptors or portions thereof, dimers or portions thereof, so as to retain only the polypeptide chain of interest.

The set of pdf files contains the polypeptide 3D structure coordinates of the 10 structures having the highest sequence homology with the peptide or peptidomimetic for which the RMSD value is to be calculated.

STEP 1.2: Performing the structural alignment of the set of 3D structure coordinates obtained in STEP 1.1, thereby obtaining a set of aligned polypeptide 3D structure coordinates, by using STAMP (Structural Alignment of Multiple Proteins Version 4.2) according to the following procedure:
1. Open the following link to access the "STAMP superposition" tool: www.russelllab.org/cgi-bin/pdc/stamp.pl
2. In the section entitled "Structure A", input the PDB file corresponding to the first structure from the set of ten 3D structure coordinates obtained in STEP 1.1, which corresponds to the best sequence alignment with BLAST.
3. In the section entitled "Structure B", input the PDB file corresponding to the second structure from the set of ten 3D structure coordinates obtained in STEP 1.1, which corresponds to the second best sequence alignment with BLAST.
4. Run STAMP.
5. Repeat steps 2 to 4 with the other eight pdb files from the set of ten 3D structure coordinates identified in STEP 1.1 by successively entering the PDB files in the field "Structure B".
6. As a result, the structural alignment of the 10 structures contained in the set of PDB files obtained in STEP 1.1 is obtained in the form of 9 distinct PDB files each containing a pair of aligned polypeptide 3D structure (structure 1 with structure 2, structure 1 with structure 3, structure 1 with structure 4, . . . , structure 1 with structure 10).
7. From these 9 "pair" PDB files, 10 PDB files each containing one of structures 1 to 10 are created.
8. 10 PDB files containing the aligned 3D structure coordinates are thus obtained from STEP 1.2. for use in the next step.

STEP 1.3: Modelling the sequence of peptide or peptidomimetic for which the RMSD value is to be calculated against the set of aligned polypeptide 3D structure coordinates obtained in STEP 1.2, thereby obtaining a set of 3D structure coordinates for the peptide or peptidomimetic for which the RMSD value is to be calculated, using SCWRL (reference: "SCWRL and MolIDE: computer programs for side-chain conformation prediction and homology modeling", Nature Protocols VOL. 3 NO. 12 2008, Qiang Wang et al.; which is hereby incorporated by reference in its entirety) according to the following procedure:
1. Insert the input sequence of a peptide or peptidomimetic for which the RMSD value is to be calculated in Fasta format.
2. Import the first PDB file containing the aligned polypeptide 3D structure coordinates obtained in STEP 1.2.
3. Run SCWRL by typing the following command for Unix based systems: "scwrl_path/scwrl3-i inputpdbfile -o outputpdbfile -s sequencefile 4 logfile".
4. As a result, a first PBD file is obtained containing the predicted 3D structure coordinates of the peptide or peptidomimetic for which the RMSD value is to be calculated.
5. Repeat steps 1 to 3 using the 9 remaining PDB files obtained in STEP 1.2.
6. 10 PDB files are obtained from STEP 1.3 for use in the following STEP 1.4.

STEP 1.4: Minimizing the free energy (ΔG) of the set of 3D structure coordinates for the peptide or peptidomimetic for which the RMSD value is to be calculated obtained in STEP 1.3 using GROMACS (Reference: Hess B, Kutzner C, Van Der Spoel D, Lindahl E (2008). "GROMACS 4: Algorithms for Highly Efficient, Load-Balanced, and Scalable Molecular Simulation". J Chem Theory Comput 4 (2): 435; which is hereby incorporated by reference in its entirety) according to the following procedure:
1. Create a Gromacs topology (gmx) file from the first PDB file of the modeled peptide or peptidomimetic for which the RMSD value is to be calculated obtained in STEP 1.3, by using the command «pdb2gmx -f NOMDUFICHIER-PDB.pdb -water spc». "NOMDUFICHIERPDB" is the name of the input PDB file.
2. Create a box around the imported modeled peptide or peptidomimetic by using the command «editconf -f conf.gro -bt cubic d 0.7 o box.gro».
3. Add solvent (water) molecules into the box by using the command «genbox -cp box.gro -es spc216.gro p topol.top -o solvated.gro».

4. Prepare the input for the molecular dynamics (MD) run with the command «vim em.mdp». Default run is set to 1000 nsteps.
5. Create an input for the MD run by using the command «grompp -f em.mdp -p topol.top -c solvated.gro -o em.tpr».
6. Run the command «mdrun -v -deffnm em» to perform the actual energy minimization.
7. Run the command «g energy -f em.edr -s em.tpr -o em.xvg» and then run option «7».
8. As a result, a first XMG file is obtained. To view the XMG file run the command «xmgrace em.xvg».
9. Repeat steps 1 to 8 with the 9 remaining structures obtained in STEP 1.3. 10 XMG files are thus obtained.
10. The structure of lowest energy is obtained from each XMG file in the form of a PDB file. 10 PDB files each containing one structure of lowest energy are thus obtained from STEP 1.4 for use in the next step.

STEP 2: Calculating the RMSD of the peptide or peptidomimetic for which the RMSD value is to be calculated by comparing the 3D structure coordinates of the peptide or peptidomimetic obtained in STEP 1.4 with the 3D structure coordinates of PEPREF to obtain the lowest possible RMSD value using FATCAT (Flexible structure AlignmenT by Chaining Aligned fragment pairs allowing Twists) according to the following procedure:
1. Open the following link to access the "FATCAT" software: fatcat.burnham.org
2. Open the "pairwise alignment" tool.
3. Import the PDB file containing the structure coordinates of PEPREF in the "Get the 1st structure" section.
4. Import the first PDB file of the peptide or peptidomimetic for which the RMSD value is to be calculated with minimized energy obtained in STEP 1.4.
5. Run FATCAT.
6. As a result, a first RMSD value of the first structure of the peptide or peptidomimetic for which the RMSD value is to be calculated as obtained in STEP 1.4 will be obtained in the output report.
7. Repeat steps 1 to 5 with the 9 remaining structures (PDB files) obtained from STEP 1.4.
8. The peptide or peptidomimetic structure with the lowest RMSD (out of the ten RMSD values successively obtained) is the value taken into account in the present application to select peptides or peptidomimetics having cell differentiation and tissue regeneration capabilities.

3D structure coordinates of PEPREF: As used herein, unless indicated otherwise or contradictory in context, the 3D structure coordinates of PEPREF are as follows:

| ATOM | 511 | N   | LYS | A | 1 | −14.570 | 46.437 | 27.424 |
| ATOM | 512 | CA  | LYS | A | 1 | −13.512 | 45.748 | 28.151 |
| ATOM | 513 | C   | LYS | A | 1 | −13.655 | 44.259 | 27.884 |
| ATOM | 514 | O   | LYS | A | 1 | −12.769 | 43.463 | 28.197 |
| ATOM | 515 | CB  | LYS | A | 1 | −13.605 | 46.029 | 29.652 |
| ATOM | 516 | CG  | LYS | A | 1 | −13.640 | 47.509 | 29.991 |
| ATOM | 517 | CD  | LYS | A | 1 | −12.615 | 48.297 | 29.183 |
| ATOM | 518 | CE  | LYS | A | 1 | −12.625 | 49.768 | 29.575 |
| ATOM | 519 | NZ  | LYS | A | 1 | −13.994 | 50.369 | 29.497 |
| ATOM | 520 | N   | ILE | A | 2 | −14.792 | 43.890 | 27.309 |
| ATOM | 521 | CA  | ILE | A | 2 | −15.051 | 42.499 | 26.967 |
| ATOM | 522 | C   | ILE | A | 2 | −14.911 | 42.370 | 25.444 |
| ATOM | 523 | O   | ILE | A | 2 | −15.531 | 43.125 | 24.683 |
| ATOM | 524 | CB  | ILE | A | 2 | −16.466 | 42.065 | 27.401 |
| ATOM | 525 | CG1 | ILE | A | 2 | −16.630 | 42.238 | 28.915 |
| ATOM | 526 | CG2 | ILE | A | 2 | −16.710 | 40.629 | 26.985 |
| ATOM | 527 | CD1 | ILE | A | 2 | −15.631 | 41.478 | 29.30  |
| ATOM | 528 | N   | PRO | A | 3 | −14.085 | 41.411 | 24.989 |

-continued

| | | | | | | | |
|---|---|---|---|---|---|---|---|
| ATOM | 529 | CA | PRO | A | 3 | -13.789 | 41.109 | 23.588 |
| ATOM | 530 | C | PRO | A | 3 | -14.998 | 40.695 | 22.768 |
| ATOM | 531 | O | PRO | A | 3 | -15.969 | 40.164 | 23.305 |
| ATOM | 532 | CB | PRO | A | 3 | -12.785 | 39.968 | 23.688 |
| ATOM | 533 | CG | PRO | A | 3 | -12.156 | 40.166 | 25.007 |
| ATOM | 534 | CD | PRO | A | 3 | -13.330 | 40.506 | 25.867 |
| ATOM | 535 | N | LYS | A | 4 | -14.937 | 40.937 | 21.463 |
| ATOM | 536 | CA | LYS | A | 4 | -16.023 | 40.529 | 20.590 |
| ATOM | 537 | C | LYS | A | 4 | -15.886 | 39.015 | 20.391 |
| ATOM | 538 | O | LYS | A | 4 | -14.903 | 38.415 | 20.831 |
| ATOM | 539 | CB | LYS | A | 4 | -15.926 | 41.244 | 19.245 |
| ATOM | 540 | CG | LYS | A | 4 | -15.802 | 42.751 | 19.355 |
| ATOM | 541 | CD | LYS | A | 4 | -16.292 | 43.433 | 18.083 |
| ATOM | 542 | CE | LYS | A | 4 | -16.162 | 44.943 | 18.177 |
| ATOM | 543 | NZ | LYS | A | 4 | -16.825 | 45.628 | 17.019 |
| ATOM | 544 | N | ALA | A | 5 | -16.85 | 38.393 | 19.759 |
| ATOM | 545 | CA | ALA | A | 5 | -16.811 | 36.955 | 19.507 |
| ATOM | 546 | C | ALA | A | 5 | -15.772 | 36.771 | 18.416 |
| ATOM | 547 | O | ALA | A | 5 | -15.727 | 37.534 | 17.455 |
| ATOM | 548 | CB | ALA | A | 5 | -18.168 | 36.419 | 19.043 |
| ATOM | 549 | N | CYS | A | 6 | -14.935 | 35.756 | 18.562 |
| ATOM | 550 | CA | CYS | A | 6 | -13.887 | 35.518 | 17.584 |
| ATOM | 551 | C | CYS | A | 6 | -14.347 | 34.765 | 16.338 |
| ATOM | 552 | O | CYS | A | 6 | -15.327 | 34.018 | 16.368 |
| ATOM | 553 | CB | CYS | A | 6 | -12.743 | 34.768 | 18.241 |
| ATOM | 554 | SG | CYS | A | 6 | -11.198 | 34.959 | 17.353 |
| ATOM | 555 | N | CYS | A | 7 | -13.623 | 34.973 | 15.243 |
| ATOM | 556 | CA | CYS | A | 7 | -13.931 | 34.328 | 13.969 |
| ATOM | 557 | C | CYS | A | 7 | -13.091 | 33.071 | 13.798 |
| ATOM | 558 | O | CYS | A | 7 | -11.961 | 33.123 | 13.302 |
| ATOM | 559 | CB | CYS | A | 7 | -13.653 | 35.290 | 12.824 |
| ATOM | 560 | SG | CYS | A | 7 | -13.930 | 34.633 | 11.154 |
| ATOM | 561 | N | VAL | A | 8 | -13.654 | 31.941 | 14.209 |
| ATOM | 562 | CA | VAL | A | 8 | -12.949 | 30.684 | 14.110 |
| ATOM | 563 | C | VAL | A | 8 | -13.653 | 29.733 | 13.157 |
| ATOM | 564 | O | VAL | A | 8 | -14.759 | 30.016 | 12.687 |
| ATOM | 565 | CB | VAL | A | 8 | -12.814 | 30.038 | 15.492 |
| ATOM | 566 | CG1 | VAL | A | 8 | -11.807 | 30.825 | 16.337 |
| ATOM | 567 | CG2 | VAL | A | 8 | -14.161 | 30.006 | 16.170 |
| ATOM | 568 | N | PRO | A | 9 | -13.003 | 28.601 | 12.828 |
| ATOM | 569 | CA | PRO | A | 9 | -13.593 | 27.615 | 11.918 |
| ATOM | 570 | C | PRO | A | 9 | -14.726 | 26.886 | 12.631 |
| ATOM | 571 | O | PRO | A | 9 | -14.581 | 26.476 | 13.780 |
| ATOM | 572 | CB | PRO | A | 9 | -12.423 | 26.676 | 11.601 |
| ATOM | 573 | CG | PRO | A | 9 | -11.204 | 27.487 | 11.925 |
| ATOM | 574 | CD | PRO | A | 9 | -11.620 | 28.226 | 13.163 |
| ATOM | 575 | N | THR | A | 10 | -15.847 | 26.721 | 11.942 |
| ATOM | 576 | CA | THR | A | 10 | -16.999 | 26.060 | 12.527 |
| ATOM | 577 | C | THR | A | 10 | -17.334 | 24.767 | 11.804 |
| ATOM | 578 | O | THR | A | 10 | -18.097 | 23.943 | 12.303 |
| ATOM | 579 | CB | THR | A | 10 | -18.211 | 27.010 | 12.523 |
| ATOM | 580 | OG1 | THR | A | 10 | -18.491 | 27.445 | 11.185 |
| ATOM | 581 | CG2 | THR | A | 10 | -17.902 | 28.230 | 13.375 |
| ATOM | 582 | N | GLU | A | 11 | -16.750 | 24.586 | 10.627 |
| ATOM | 583 | CA | GLU | A | 11 | -16.980 | 23.377 | 9.848 |
| ATOM | 584 | C | GLU | A | 11 | -15.643 | 22.935 | 9.246 |
| ATOM | 585 | O | GLU | A | 11 | -15.029 | 23.666 | 8.464 |
| ATOM | 586 | CB | GLU | A | 11 | -17.981 | 23.624 | 8.715 |
| ATOM | 587 | CG | GLU | A | 11 | -19.421 | 23.807 | 9.163 |
| ATOM | 588 | CD | GLU | A | 11 | -19.686 | 25.166 | 9.770 |
| ATOM | 589 | OE1 | GLU | A | 11 | -19.478 | 26.175 | 9.073 |
| ATOM | 590 | OE2 | GLU | A | 11 | -20.111 | 25.227 | 10.939 |
| ATOM | 591 | N | LEU | A | 12 | -15.183 | 21.749 | 9.622 |
| ATOM | 592 | CA | LEU | A | 12 | -13.923 | 21.254 | 9.104 |
| ATOM | 593 | C | LEU | A | 12 | -14.062 | 19.912 | 8.386 |
| ATOM | 594 | O | LEU | A | 12 | -15.136 | 19.299 | 8.359 |
| ATOM | 595 | CB | LEU | A | 12 | -12.893 | 21.144 | 10.230 |
| ATOM | 596 | CG | LEU | A | 12 | -12.660 | 22.422 | 11.054 |
| ATOM | 597 | CD1 | LEU | A | 12 | -13.475 | 22.350 | 12.337 |
| ATOM | 598 | CD2 | LEU | A | 12 | -11.181 | 22.586 | 11.399 |
| ATOM | 599 | N | SER | A | 13 | -12.971 | 19.476 | 7.771 |
| ATOM | 600 | CA | SER | A | 13 | -12.964 | 18.218 | 7.046 |
| ATOM | 601 | C | SER | A | 13 | -11.568 | 17.628 | 7.164 |
| ATOM | 602 | O | SER | A | 13 | -10.613 | 18.320 | 7.550 |
| ATOM | 603 | CB | SER | A | 13 | -13.346 | 18.435 | 5.578 |
| ATOM | 604 | OG | SER | A | 13 | -12.404 | 19.261 | 4.923 |
| ATOM | 605 | N | ALA | A | 13 | -11.449 | 16.352 | 6.818 |
| ATOM | 606 | CA | ALA | A | 13 | -10.179 | 15.665 | 6.949 |
| ATOM | 607 | C | ALA | A | 13 | -9.421 | 15.471 | 5.652 |
| ATOM | 608 | O | ALA | A | 13 | -9.941 | 15.720 | 4.563 |
| ATOM | 609 | CB | ALA | A | 13 | -10.413 | 14.306 | 7.626 |
| ATOM | 610 | N | ILE | A | 14 | -8.171 | 15.046 | 5.783 |
| ATOM | 611 | CA | ILE | A | 14 | -7.343 | 14.746 | 4.623 |
| ATOM | 612 | C | ILE | A | 14 | -6.475 | 13.559 | 5.004 |
| ATOM | 613 | O | ILE | A | 14 | -6.212 | 13.316 | 6.183 |
| ATOM | 614 | CB | ILE | A | 14 | -6.401 | 15.916 | 4.183 |
| ATOM | 615 | CG1 | ILE | A | 14 | -5.284 | 16.106 | 5.200 |
| ATOM | 616 | CG2 | ILE | A | 14 | -7.188 | 17.211 | 3.982 |
| ATOM | 617 | CD1 | ILE | A | 14 | -4.173 | 16.973 | 4.696 |
| ATOM | 618 | N | SER | A | 15 | -6.045 | 12.806 | 3.999 |
| ATOM | 619 | CA | SER | A | 15 | -5.187 | 11.662 | 4.242 |
| ATOM | 620 | C | SER | A | 15 | -3.740 | 12.089 | 4.217 |
| ATOM | 621 | O | SER | A | 15 | -3.360 | 13.020 | 3.508 |
| ATOM | 622 | CB | SER | A | 15 | -5.416 | 10.584 | 3.185 |
| ATOM | 623 | OG | SER | A | 15 | -6.667 | 9.971 | 3.401 |
| ATOM | 624 | N | MET | A | 16 | -2.933 | 11.409 | 5.012 |
| ATOM | 625 | CA | MET | A | 16 | -1.518 | 11.700 | 5.047 |
| ATOM | 626 | C | MET | A | 16 | -0.778 | 10.414 | 5.244 |
| ATOM | 627 | O | MET | A | 16 | -1.137 | 9.594 | 6.078 |
| ATOM | 628 | CB | MET | A | 16 | -1.170 | 12.694 | 6.164 |
| ATOM | 629 | CG | MET | A | 16 | -1.848 | 14.042 | 5.974 |
| ATOM | 630 | SD | MET | A | 16 | -1.017 | 15.431 | 6.760 |
| ATOM | 631 | CE | MET | A | 16 | -0.799 | 14.823 | 8.475 |
| ATOM | 632 | N | LEU | A | 17 | 0.238 | 10.231 | 4.426 |
| ATOM | 633 | CA | LEU | A | 17 | 1.077 | 9.065 | 4.508 |
| ATOM | 634 | C | LEU | A | 17 | 2.289 | 9.610 | 5.264 |
| ATOM | 635 | O | LEU | A | 17 | 2.939 | 10.565 | 4.818 |
| ATOM | 636 | CB | LEU | A | 17 | 1.461 | 8.608 | 3.100 |
| ATOM | 637 | CG | LEU | A | 17 | 2.324 | 7.355 | 2.955 |
| ATOM | 638 | CD1 | LEU | A | 17 | 1.553 | 6.145 | 3.445 |
| ATOM | 639 | CD2 | LEU | A | 17 | 2.723 | 7.190 | 1.492 |
| ATOM | 640 | N | TYR | A | 18 | 2.581 | 9.029 | 6.418 |
| ATOM | 641 | CA | TYR | A | 18 | 3.706 | 9.501 | 7.196 |
| ATOM | 642 | C | TYR | A | 18 | 4.434 | 8.333 | 7.835 |
| ATOM | 643 | O | TYR | A | 18 | 4.081 | 7.186 | 7.603 |
| ATOM | 644 | CB | TYR | A | 18 | 3.222 | 10.458 | 8.281 |
| ATOM | 645 | CG | TYR | A | 18 | 2.386 | 9.782 | 9.346 |
| ATOM | 646 | CD1 | TYR | A | 18 | 1.029 | 9.527 | 9.147 |
| ATOM | 647 | CD2 | TYR | A | 18 | 2.961 | 9.379 | 10.550 |
| ATOM | 648 | CE1 | TYR | A | 18 | 0.273 | 8.894 | 10.128 |
| ATOM | 649 | CE2 | TYR | A | 18 | 2.218 | 8.745 | 11.526 |
| ATOM | 650 | CZ | TYR | A | 18 | 0.877 | 8.508 | 11.317 |
| ATOM | 651 | OH | TYR | A | 18 | 0.134 | 7.922 | 12.318 |
| ATOM | 652 | N | LEU | A | 19 | 5.439 | 8.651 | 8.650 |
| ATOM | 653 | CA | LEU | A | 19 | 6.255 | 7.661 | 9.347 |
| ATOM | 654 | C | LEU | A | 19 | 6.210 | 7.946 | 10.847 |
| ATOM | 655 | O | LEU | A | 19 | 6.685 | 8.992 | 11.288 |
| ATOM | 656 | CB | LEU | A | 19 | 7.701 | 7.763 | 8.871 |
| ATOM | 657 | CG | LEU | A | 19 | 7.901 | 7.850 | 7.359 |
| ATOM | 658 | CD1 | LEU | A | 19 | 9.300 | 8.379 | 7.039 |
| ATOM | 659 | CD2 | LEU | A | 19 | 7.669 | 6.482 | 6.748 |

Structure coordinates: As used herein, unless indicated otherwise or contradictory in context, the "structure coordinates" refers to Cartesian coordinates derived from mathematical equations related to the patterns obtained on diffraction of a monochromatic beam of X-rays by the atoms (scattering centers) of a protein, protein complex or peptide in crystal form. The diffraction data are used to calculate an electron density map of the repeating unit of the crystal. The electron density maps are then used to establish the positions of the individual atoms of the molecule or molecular complex.

STAMP: STAMP (Structural Alignment of Multiple Proteins) is a tool for aligning protein sequences based on a three-dimensional structure. Its algorithm minimizes the Ca distance between aligned residues of each molecule by applying globally optimal rigid-body rotations and translations. This program provides some information on the equivalence of the residues between the selected models.

SCWRL: This program predicts and optimizes the protein side-chain conformations. It is using the backbone of a support protein and a backbone-dependent rotamer library.

The possible conformations are explored by minimizing the steric hindrance between the side-chains and between the side-chains and the backbone.

GROMACS: GROMACS is a molecular dynamics package. The "gmx rms" tool included in GROMACS compares two structures by computing the root mean square deviation (RMSD).

II. Growth Factor Receptor-Binding Compounds

In one aspect, the present disclosure provides for growth factor receptor-binding compounds having the ability to induce stem cell differentiation and promote tissue regeneration.

As used herein, the term "growth factor receptor-binding compound", "GFR-binding compound" or "GFRBC" refers to an exogenous or endogenous compound, molecule or substance having an (binding) affinity for a growth factor receptor as defined herein, and optionally comprising the ability to associate or combine with a bioactive carrier as defined herein.

There are many ways to test, measure and present the binding affinity of a given substance for a given receptor, but for the purpose of the present disclosure, and for the avoidance of any doubts, the (binding) affinity values of a given GFR-binding compound to a given GFR are provided using the method of fluorescence anisotropy. In this method, a GFR-binding compound is fluorescently labelled using technics well established in the art. Binding of the resulting labelled compound to a growth factor receptor results in a fluctuation of fluorescence anisotropy which is used to construct an affinity binding curve from which the GFR-binding compound binding affinity value is derived. Using this technique, binding affinity values are given in the form of dissociation constants Kd. In certain embodiments, GFR-binding compounds of the present disclosure have Kd values as measured by fluorescence anisotropy of more than 1 (one) picomolar (pM). In certain embodiments, GFR-binding compounds of the present disclosure have Kd values as measured by fluorescence anisotropy of more than 1 (one) nanomolar (nM). In certain embodiments, GFR-binding compounds of the present disclosure have Kd values as measured by fluorescence anisotropy of more than 10 (ten) nanomolar (nM). In certain embodiments, GFR-binding compounds of the present disclosure have Kd values as measured by fluorescence anisotropy of more than 100 (one hundred) nanomolar (nM). In certain embodiments, GFR-binding compounds of the present disclosure have Kd values as measured by fluorescence anisotropy of more than 1 (one) micromolar (μM). In certain embodiments, GFR-binding compounds of the present disclosure have Kd values as measured by fluorescence anisotropy of more than 10 (ten) micromolar (μM). In certain embodiments, GFR-binding compounds of the present disclosure have Kd values as measured by fluorescence anisotropy of more than 100 (one hundred) micromolar (μM).

A GFR-binding compound is said to possess the ability to associate or combine with a bioactive carrier if it comprises a functional chemical element, function or group allowing for the covalent or non-covalent assembly of the GFR-binding compound and the bioactive carrier. Such a functional chemical element, function or group, also referred to as a bioactive carrier-affinity-containing group or bioactive carrier-high-affinity-containing group, include, but is not limited to, a thiol-containing compound, a cysteine-containing compound, a cysteine, or a GTPGP (SEQ ID NO: 6610) or a WWFWG (SEQ ID NO: 6611) peptide fragment.

Growth factor receptor: As used herein, unless indicated otherwise or contradictory in context, the term "growth factor receptor" or "GFR" is a receptor which binds to growth factors which are naturally occurring substances capable of stimulating, for instance, cellular growth, proliferation, healing, and cellular differentiation. Suitable as growth factor receptors for implementing embodiments of the present invention include epidermal growth factor receptors (EGFR), fibroblast growth factor receptors (FGFR), vascular endothelial growth factor receptors (VEGFR), nerve growth factor receptors (NGFR), Insulin receptor family, Trk receptor family, Eph receptor family, AXL receptor family, LTK receptor family, TIE receptor family, ROR receptor family, DDR receptor family, RET receptor family, KLG receptor family, RYK receptor family, MuSK receptor family, hepatocyte growth factor receptors (HGFR), somatomedin or insulin-like growth factor receptors (SGFR), platelet-derived growth factor receptors (PDGFR), transforming growth factor beta (TGF-β) superfamily proteins such as AMH, ARTN, BMP10, BMP15, BMP2, BMP3, BMP4, BMP5, BMP6, BMP7, BMP8A, BMP8B, GDF1, GDF10, GDF11, GDF15, GDF2, GDF3, GDF3A, GDF5, GDF6, GDF7, GDF8, GDF9, GDNF, INHA, INHBA, INHBB, INHBC, INHBE, LEFTY1, LEFTY2, MSTN, NODAL, NRTN, PSPN, TGFB1, TGFB2 and TGFB3, and any combination thereof.

Growth factor: As used herein, unless indicated otherwise or contradictory in context, the term "growth factor" refers to any substance(s) having the ability to bind to a growth factor receptor and produce (a) biological effect(s) or reaction(s), such as promoting the growth of tissues, by activating such a growth factor receptor. Exemplary growth factors include, but are not limited to, platelet-derived growth factor (PDGF), platelet-derived angiogenesis factor (PDAF), vascular endotheial growth factor (VEGF), platelet-derived epidermal growth factor (PDEGF), transforming growth factor beta (TGF-β), transforming growth factor A (TGF-A), epidermal growth factor (EGF), fibroblast growth factor (FGF), acidic fibroblast growth factor (FGF-A), basic fibroblast growth factor (FGF-B), insulin-like growth factors 1 and 2 (IGF-1 and IGF-2), keratinocyte growth factor (KGF), tumor necrosis factor (TNF), fibroblast growth factor (FGF) and interleukin-1 (IL-1), Keratinocyte Growth Factor-2 (KGF-2), and combinations thereof.

Activation of growth factor receptors: As used herein, unless indicated otherwise or contradictory in context, the term "activating" or "activation of", when used in relation to a growth factor receptor, refers to the phosphorylation of the tyrosine kinase domain of such a growth factor receptor.

In one aspect, the present disclosure provides a GFR-binding compound having mesenchymal stem cell and progenitor cell commitment and/or differentiation and/or maturation capacities resulting in tissue regeneration.

In one example, said GFR-binding compound has a molecular weight of less than 4,000 Daltons. In one particular example, said GFR-binding compound has a molecular weight of less than 3,000 Daltons. In one particular example, said GFR-binding compound has a molecular weight comprised between 600 and 4,000 Daltons. In one particular example, said GFR-binding compound has a molecular weight comprised between 800 and 4,000 Daltons. In one particular example, said GFR-binding compound has a molecular weight comprised between 600 and 3,000 Daltons. In one particular example, said GFR-binding compound has a molecular weight comprised between 800 and 3,000 Daltons. Between 800 and 3,000 Daltons is particularly preferred.

In one particular example, the growth factor receptor involved in the interaction with said GFR-binding compound is an epidermal growth factor receptor. In one particular example, the growth factor receptor involved in the interaction with said GFR-binding compound is a fibroblast growth factor receptor. In one particular example, the growth factor receptor involved in the interaction with said GFR-binding compound is a vascular endothelial growth factor receptor. In one particular example, the growth factor receptor involved in the interaction with said GFR-binding compound is a nerve growth factor receptor. In one particular example, the growth factor receptor involved in the interaction with said GFR-binding compound is a hepatocyte growth factor receptor. In one particular example, the growth factor receptor involved in the interaction with said GFR-binding compound is a somatomedin or insulin-like growth factor receptor. In one particular example, the growth factor receptor involved in the interaction with said GFR-binding compound is a platelet-derived growth factor receptor. In one particular example, the growth factor receptor involved in the interaction with said GFR-binding compound is a protein from the transforming growth factor beta (TGF-β) superfamily.

In one particular example, the growth factor receptor(s) involved in the interaction with said GFR-binding compound is (are) preferably selected from epidermal growth factor receptors, fibroblast growth factor receptors, vascular endothelial growth factor receptors, nerve growth factor receptors, hepatocyte growth factor receptors, somatomedin or insulin-like growth factor receptors, platelet-derived growth factor receptors, and transforming growth factor beta (TGF-β) superfamily proteins.

In one particular example, said GFR-binding compound is a peptide, or a variant or analog thereof, exclusively consisting of (or constituted of) between 8-30 amino acids, in particular between 8-25 amino acids or between 8-22 amino acids, more particularly between 18-22 amino acids, even more particularly between 19-21 or 20 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein (hereinafter also referred to as "wherein the RMSD is 2.45 Å or less" for the sake of conciseness).

In one particular example, said GFR-binding compound is a peptide, or a variant or analog thereof, exclusively consisting of (or constituted of) between 8-30 amino acids; wherein the RMSD value of the three dimensional (3D) atomic coordinates of said GFR-binding compound with respect to PEPREF is 2.45 Å (Angstroms) or less, in particular is 2 Å, or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 8-30 amino acids, in particular between 8-25 amino acids or between 8-22 amino acids, more particularly between 18-22 amino acids, even more particularly between 19-21 or 20 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 8-25 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 8-22 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 18-22 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 19-21 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) 20 amino acid; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 8-18 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptide, or a variant or analog thereof, exclusively consisting of (or constituted of) between 22-30 amino acids; wherein the RMSD value of the three dimensional (3D) atomic coordinates of said GFR-binding compound with respect to PEPREF is 2.45 Å (Angstroms) or less, in particular is 2 Å or less, and more particularly is 1.79 Å or less, and wherein PEPREF is the set of 3D atomic coordinates already defined herein.

In one particular example, said GFR-binding compound is a peptidomimetic as defined herein, comprising (consecutively or non-consecutively) between 8-30 amino acids, in particular between 8-25 amino acids or between 8-22 amino acids, more particularly between 18-22 amino acids, even more particularly between 19-21 or 20; wherein said GFR-binding compound has a molecular weight comprised between 600 and 4,000 Daltons (in particular, between 800-4,000 Da, 600-3,000 Da, more particularly between 800-3,000 Da);

In one aspect, the present disclosure provides a GFR-binding compound, wherein said GFR-binding compound is a peptide, a variant or analog thereof, or a peptidomimetic as defined herein, having growth factor receptor-binding capability or capabilities, having a molecular weight of between 600-4,000 Da, 600-3,000 Da, or 800-4,000 Da, in particular between 800 and 3,000 Da; and wherein the RMSD is 2.45 Å or less.

In one aspect, the present disclosure provides a GFR-binding compound, wherein said GFR-binding compound is a peptide, a variant or analog thereof, or a peptidomimetic as defined herein, having growth factor receptor-binding capability or capabilities, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with three amino acids (PEP3); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); wherein said GFR-binding compound further comprises a peptide with three amino acids (PEP3); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with five amino acids (PEP5); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); wherein said GFR-binding compound further comprises a peptide with five amino acids (PEP5); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with between six and twelve amino acids (PEP9); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); wherein said GFR-binding compound further comprises a peptide with between six and twelve amino acids (PEP9); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with three amino acids (PEP3), an amino acid or a peptide with between two and seven amino acids (PEP7); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP12); wherein said GFR-binding compound further comprises a peptide with three amino acids (PEP3), an amino acid or a peptide with between two and seven amino acids (PEP7); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with five amino acids (PEP5), an amino acid or a peptide with between two and seven amino acids (PEP7); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP12); wherein said GFR-binding compound further comprises a peptide with five amino acids (PEP5), an amino acid or a peptide with between two and seven amino acids (PEP7); and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (I) (hereinafter may also be referred to as compound (I) or peptide (I)):

PEP(C)-PEP12     (I)

wherein PEP12 is a peptide with 8 amino acids of formula PEP1-AA$^{17}$-PEP11 as defined herein; wherein one end of PEP(C) interacts covalently with PEP12 via one end of PEP1; wherein PEP(C) is a peptide with at least 5 amino acids, in particular a peptide with between 5 and 12 amino acids; and wherein the RMSD is 2.45 Å or less.

In one aspect, the present disclosure provides a GFR-binding compound of general formula (I), wherein PEP(C) comprises PEP3; and wherein the RMSD is 2.45 Å or less.

In one aspect, the present disclosure provides a GFR-binding compound of general formula (I), wherein PEP(C) comprises PEP5; and wherein the RMSD is 2.45 Å or less. In one particular example, PEP(C) is PEP5.

In one aspect, the present disclosure provides a GFR-binding compound of general formula (I), wherein PEP(C) comprises PEP9; and wherein the RMSD is 2.45 Å or less. In one particular example, PEP(C) is PEP9.

In one aspect, the present disclosure provides a GFR-binding compound of general formula (I), wherein PEP(C) comprises PEP3 and PEP7; and wherein the RMSD is 2.45 Å or less.

In one aspect, the present disclosure provides a GFR-binding compound of general formula (I), wherein PEP(C) comprises PEP5 and PEP7; and wherein the RMSD is 2.45 Å or less.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (II) (hereinafter may also be referred to as compound (II) or peptide (II)):

PEP7-PEP5-PEP12     (II)

wherein PEP12 is a peptide with 8 amino acids of formula PEP1-AA$^{17}$-PEP11 as defined herein; wherein PEP5 is a peptide with five amino acids as defined herein; wherein PEP7 is an amino acid or a peptide with between two and seven amino acids as defined herein; wherein one end of PEP5 interacts covalently with one end of PEP12 via one end of PEP1; wherein another end of PEP5 interacts covalently with one end of PEP7 via AA$^7$; and wherein the RMSD is 2.45 Å or less.

In certain embodiments, PEP1 is selected from the group consisting of SAIS (SEQ ID NO: 6360), SSLS (SEQ ID NO: 6365), NAIS (SEQ ID NO: 6357), SATS (SEQ ID NO: 6361), SPIS (SEQ ID NO: 6364), EPIS (SEQ ID NO: 6353), SPIN (SEQ ID NO: 6363), KPLS (SEQ ID NO: 6356), EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358).

In certain embodiments, PEP3 is selected from the group consisting of VPT, VPE, APT, TPT, VPA, APV, VPQ, VSQ, SRV and TQV.

In certain embodiments, PEP5 is a peptide of general formula PEP3-AA$^{11}$-AA$^{12}$; wherein PEP3 is selected from the group consisting of VPT, VPE, APT, TPT, VPA, APV, VPQ, VSQ, SRV and TQV; wherein AA$^{11}$ is selected from the group consisting of E, K, Q, R, A, D, G and H; and wherein AA$^{12}$ is selected from the group consisting of L, M, T, E, Q and H. In one particular example, PEP5 is selected from the group consisting of VPTEL (SEQ ID NO: 6421), VPEKM (SEQ ID NO: 6406), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427), APVKT (SEQ ID NO: 6379), VPQAL (SEQ ID NO: 6410), VSQDL (SEQ ID NO: 6429), VPQDL (SEQ ID NO: 6411), VPTEE (SEQ ID NO: 6420), VPTGQ (SEQ ID NO: 6422), SRVHH (SEQ ID NO: 6382) and TQVQL (SEQ ID NO: 6393).

In certain embodiments, PEP7 is an amino acid or a peptide with between two and seven amino acids of general formula AA$^1$-AA$^2$-AA$^3$-AA$^4$-AA$^5$-AA$^6$-AA$^7$ (SEQ ID NO: 6606); wherein AA$^1$, AA$^2$, AA$^3$, AA$^4$, and AA$^5$ are independently absent or AA$^1$ as defined herein; wherein AA$^6$ is absent or selected from the group consisting of S, T, C, E, Q, P and R; wherein AA$^7$ is absent or is selected from the group consisting of S, T, C, E, Q, P and R, and wherein at least one of AA$^1$, AA$^2$, AA$^3$, AA$^4$, AA$^5$, AA$^6$ or AA$^7$ is not absent. In one particular example, PEP7 is selected from the group consisting of KIPKAXX (SEQ ID NO: 6445), GIPEPXX (SEQ ID NO: 6440), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPASXX (SEQ ID NO: 6436), STPPTXX (SEQ ID NO: 6452), HVPKPXX (SEQ ID NO: 6442), RVPSTXX (SEQ ID NO: 6449), ASAAPXX (SEQ ID NO: 6437), ASASPXX (SEQ ID NO: 6438), NDEGLEX (SEQ ID NO: 6447), SSVKXQP (SEQ ID NO: 6451) and RNVQXRP (SEQ ID NO: 6448), wherein X is C or S throughout the present description.

In certain embodiments, PEP9 is a peptide of general formula PEP7-PEP5; wherein PEP5 is a peptide of formula PEP3-AA$^{11}$-AA$^{12}$; wherein PEP3 is selected from the group consisting of VPT, VPE, APT, TPT, VPA, APV, VPQ, VSQ, SRV and TQV; wherein AA$^{11}$ is selected from the group consisting of E, K, Q, R, A, D, G and H; and wherein AA$^{12}$ is selected from the group consisting of L, M, T, E, Q and H; wherein PEP7 is an amino acid or a peptide with between two and seven amino acids of general formula AA$^1$-AA$^2$-AA$^3$-AA$^4$-AA$^5$-AA$^6$-AA$^7$ (SEQ ID NO: 6606); wherein AA$^1$, AA$^2$, AA$^3$, AA$^4$, and AA$^5$ are independently absent or AA$^I$ as defined herein; wherein AA$^6$ is absent or selected from the group consisting of S, T, C, E, Q, P and R; wherein AA$^7$ is absent or is selected from the group consisting of S, T, C, E, Q, P and R. In one particular example, PEP9 is selected from the group consisting of KIPKAXXVPTEL (SEQ ID NO: 6535), GIPEPXXVPEKM (SEQ ID NO: 6491), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXXTPTKM (SEQ ID NO: 6497), AAPASXXVPARL (SEQ ID NO: 6458), STPPTXXVPTRL (SEQ ID NO: 6573), HVPKPXXAPTKL (SEQ ID NO: 6503), RVPSTXXAPVKT (SEQ ID NO: 6550), ASAAPXXVPQAL (SEQ ID NO: 6468), ASASPXXVSQDL (SEQ ID NO: 6478), ASASPXXVPQDL (SEQ ID NO: 6476), NDEGLEXVP-TEE (SEQ ID NO: 6545), NDEGLEXVPTGQ (SEQ ID NO: 6546), SSVKXQPSRVHH (SEQ ID NO: 6565) and RNVQXRPTQVQL (SEQ ID NO: 6548), wherein X is C or S throughout the present description.

In certain embodiments, PEP12 is a peptide of general formula PEP1-AA$^{17}$-PEP11; wherein AA$^{17}$ is selected from the group consisting of G, A, V, L, I, P, F, M, W, T and S (in particular is selected from the group consisting of M, I, L, V and T); wherein PEP1 is selected from the group consisting of SAIS (SEQ ID NO: 6360), SSLS (SEQ ID NO: 6365), NAIS (SEQ ID NO: 6357), SATS (SEQ ID NO: 6361), SPIS (SEQ ID NO: 6364), EPIS (SEQ ID NO: 6353), SPIN (SEQ ID NO: 6363), KPLS (SEQ ID NO: 6356), EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358).

In particular, in certain embodiments, the pair PEP3:PEP1 is selected from the group consisting of VPT:SAIS (SEQ ID NO: 6360), VPE:SAIS (SEQ ID NO: 6360), APT:SAIS (SEQ ID NO: 6360), TPT:SAIS (SEQ ID NO: 6360), VPA:SAIS (SEQ ID NO: 6360), APV:SAIS (SEQ ID NO: 6360), VPQ:SAIS (SEQ ID NO: 6360), VSQ:SAIS (SEQ ID NO: 6360), SRV:SAIS (SEQ ID NO: 6360), TQV:SAIS (SEQ ID NO: 6360), VPE:SSLS (SEQ ID NO: 6365), VPT:SSLS (SEQ ID NO: 6365), APT:SSLS (SEQ ID NO: 6365), TPT:SSLS (SEQ ID NO: 6365), VPA:SSLS (SEQ ID NO: 6365), APV:SSLS (SEQ ID NO: 6365), VPQ:SSLS (SEQ ID NO: 6365), VSQ:SSLS (SEQ ID NO: 6365), SRV:SSLS (SEQ ID NO: 6365), TQV:SSLS (SEQ ID NO: 6365), APT:NAIS (SEQ ID NO: 6357), VPT:NAIS (SEQ ID NO: 6357), VPE:NAIS (SEQ ID NO: 6357), TPT:NAIS (SEQ ID NO: 6357), VPA:NAIS (SEQ ID NO: 6357), APV:NAIS (SEQ ID NO: 6357), VPQ:NAIS (SEQ ID NO: 6357), VSQ:NAIS (SEQ ID NO: 6357), SRV:NAIS (SEQ ID NO: 6357), TQV:NAIS (SEQ ID NO: 6357), APT:SATS (SEQ ID NO: 6361), VPT:SATS (SEQ ID NO: 6361), VPE:SATS (SEQ ID NO: 6361), TPT:SATS (SEQ ID NO: 6361), VPA:SATS (SEQ ID NO: 6361), APV:SATS (SEQ ID NO: 6361), VPQ:SATS (SEQ ID NO: 6361), VSQ:SATS (SEQ ID NO: 6361), SRV:SATS (SEQ ID NO: 6361), TQV:SATS (SEQ ID NO: 6361), VPT:SPIS (SEQ ID NO: 6364), VPE:SPIS (SEQ ID NO: 6364), APT:SPIS (SEQ ID NO: 6364), TPT:SPIS (SEQ ID NO: 6364), VPA:SPIS (SEQ ID NO: 6364), APV:SPIS (SEQ ID NO: 6364), VPQ:SPIS (SEQ ID NO: 6364), VSQ:SPIS (SEQ ID NO: 6364), SRV:SPIS (SEQ ID NO: 6364), TQV:SPIS (SEQ ID NO: 6364), VPT:EPIS (SEQ ID NO: 6353), VPE:EPIS (SEQ ID NO: 6353), APT:EPIS (SEQ ID NO: 6353), TPT:EPIS (SEQ ID NO: 6353), VPA:EPIS (SEQ ID NO: 6353), APV:EPIS (SEQ ID NO: 6353), VPQ:EPIS (SEQ ID NO: 6353), VSQ:EPIS (SEQ ID NO: 6353), SRV:EPIS (SEQ ID NO: 6353), TQV:EPIS (SEQ ID NO: 6353), TPT:SPIN (SEQ ID NO: 6363), VPT:SPIN (SEQ ID NO: 6363), VPE:SPIN (SEQ ID NO: 6363), APT:SPIN (SEQ ID NO: 6363), VPA:SPIN (SEQ ID NO: 6363), APV:SPIN (SEQ ID NO: 6363), VPQ:SPIN (SEQ ID NO: 6363), VSQ:SPIN (SEQ ID NO: 6363), SRV:SPIN (SEQ ID NO: 6363), TQV:SPIN (SEQ ID NO: 6363), APV:KPLS (SEQ ID NO: 6356), VPT:KPLS (SEQ ID NO: 6356), VPE:KPLS (SEQ ID NO: 6356), APT:KPLS (SEQ ID NO: 6356), TPT:KPLS (SEQ ID NO: 6356), VPA:KPLS (SEQ ID NO: 6356), VPQ:KPLS (SEQ ID NO: 6356), VSQ:KPLS (SEQ ID NO: 6356), SRV:KPLS (SEQ ID NO: 6356), TQV:KPLS (SEQ ID NO: 6356), VPQ:EPLP (SEQ ID NO: 6354), VPT:EPLP (SEQ ID NO: 6354), VPE:EPLP (SEQ ID NO: 6354), APT:EPLP (SEQ ID NO: 6354), TPT:EPLP (SEQ ID NO: 6354), VPA:EPLP (SEQ ID NO: 6354), APV:EPLP (SEQ ID NO: 6354), VSQ:EPLP (SEQ ID NO: 6354), SRV:EPLP (SEQ ID NO: 6354), TQV:EPLP (SEQ ID NO: 6354), VSQ:EPLT (SEQ ID NO: 6355), VPT:EPLT (SEQ ID NO: 6355), VPE:EPLT (SEQ ID NO: 6355), APT:EPLT (SEQ ID NO: 6355), TPT:EPLT (SEQ ID NO: 6355), VPA:EPLT (SEQ ID NO: 6355), APV:EPLT (SEQ ID NO: 6355), VPQ:EPLT (SEQ ID NO: 6355), SRV:EPLT (SEQ ID NO: 6355), TQV:EPLT (SEQ ID NO: 6355), VPT:SNIT (SEQ ID NO: 6362), VPE:SNIT (SEQ ID NO: 6362), APT:SNIT (SEQ ID NO: 6362), TPT:SNIT (SEQ ID NO: 6362), VPA:SNIT (SEQ ID NO: 6362), APV:SNIT (SEQ ID NO: 6362), VPQ:SNIT (SEQ ID NO: 6362), VSQ:SNIT (SEQ ID NO: 6362), SRV:SNIT (SEQ ID NO: 6362), TQV:SNIT (SEQ ID NO: 6362), SRV:RSVK (SEQ ID NO: 6359), VPT:RSVK (SEQ ID NO: 6359), VPE:RSVK (SEQ ID NO: 6359), APT:RSVK (SEQ ID NO: 6359), TPT:RSVK (SEQ ID NO: 6359), VPA:RSVK (SEQ ID NO: 6359), APV:RSVK (SEQ ID NO: 6359), VPQ:RSVK (SEQ ID NO: 6359), VSQ:RSVK (SEQ ID NO: 6359), TQV:RSVK (SEQ ID NO: 6359), TQV:RPVQ (SEQ ID NO: 6358), VPT:RPVQ (SEQ ID NO: 6358), VPE:RPVQ (SEQ ID NO: 6358), APT:RPVQ (SEQ ID NO: 6358), TPT:RPVQ (SEQ ID NO: 6358), VPA:RPVQ (SEQ ID NO: 6358), APV:RPVQ (SEQ ID NO: 6358), VPQ:RPVQ (SEQ ID NO: 6358), VSQ:RPVQ (SEQ ID NO: 6358) and SRV:RPVQ (SEQ ID NO: 6358).

In particular, in certain embodiments, the pair PEP5:PEP1 is selected from the group consisting of VPTKM (SEQ ID NO: 6424):SAIS (SEQ ID NO: 6360), VPTKL (SEQ ID NO: 6423):SAIS (SEQ ID NO: 6360), VPTQL (SEQ ID NO: 6426):SAIS (SEQ ID NO: 6360), VPTRL (SEQ ID NO: 6427):SAIS (SEQ ID NO: 6360), VPTKT (SEQ ID NO: 6425):SAIS (SEQ ID NO: 6360), VPTAL (SEQ ID NO: 6418):SAIS (SEQ ID NO: 6360), VPTDL (SEQ ID NO: 6419):SAIS (SEQ ID NO: 6360), VPEKM (SEQ ID NO: 6406):SAIS (SEQ ID NO: 6360), APTKL (SEQ ID NO: 6369):SAIS (SEQ ID NO: 6360), APTQL (SEQ ID NO: 6372):SAIS (SEQ ID NO: 6360), TPTKM (SEQ ID NO: 6388):SAIS (SEQ ID NO: 6360), VPARL (SEQ ID NO: 6401):SAIS (SEQ ID NO: 6360), APVKT (SEQ ID NO: 6379):SAIS (SEQ ID NO: 6360), VPQAL (SEQ ID NO: 6410):SAIS (SEQ ID NO: 6360), VSQDL (SEQ ID NO: 6429):SAIS (SEQ ID NO: 6360), VPQDL (SEQ ID NO: 6411):SAIS (SEQ ID NO: 6360), SRVHH (SEQ ID NO: 6382):SAIS (SEQ ID NO: 6360), TQVQL (SEQ ID NO: 6393):SAIS (SEQ ID NO: 6360), VPEEL (SEQ ID NO: 6404):SSLS (SEQ ID NO: 6365), VPEKL (SEQ ID NO: 6405):SSLS (SEQ ID NO: 6365), VPEQL (SEQ ID NO: 6408):SSLS (SEQ ID NO: 6365), VPEKM (SEQ ID NO: 6406):SSLS (SEQ ID NO: 6365), VPERL (SEQ ID NO:

6409):SSLS (SEQ ID NO: 6365), VPEKT (SEQ ID NO: 6407):SSLS (SEQ ID NO: 6365), VPEAL (SEQ ID NO: 6402):SSLS (SEQ ID NO: 6365), VPEDL (SEQ ID NO: 6403):SSLS (SEQ ID NO: 6365), VPTEL (SEQ ID NO: 6421):SSLS (SEQ ID NO: 6365), APTKL (SEQ ID NO: 6369):SSLS (SEQ ID NO: 6365), APTQL (SEQ ID NO: 6372):SSLS (SEQ ID NO: 6365), VPTKL (SEQ ID NO: 6423):SSLS (SEQ ID NO: 6365), TPTKM (SEQ ID NO: 6388):SSLS (SEQ ID NO: 6365), VPARL (SEQ ID NO: 6401):SSLS (SEQ ID NO: 6365), VPTRL (SEQ ID NO: 6427)SSLS (SEQ ID NO: 6365), APVKT (SEQ ID NO: 6379):SSLS (SEQ ID NO: 6365), VPQAL (SEQ ID NO: 6410):SSLS (SEQ ID NO: 6365), VSQDL (SEQ ID NO: 6429):SSLS (SEQ ID NO: 6365), VPQDL (SEQ ID NO: 6411):SSLS (SEQ ID NO: 6365), VPTEE (SEQ ID NO: 6420):SSLS (SEQ ID NO: 6365), VPTGQ (SEQ ID NO: 6422)SSLS (SEQ ID NO: 6365), SRVHH (SEQ ID NO: 6382):SSLS (SEQ ID NO: 6365), TQVQL (SEQ ID NO: 6393):SSLS (SEQ ID NO: 6365), APTEL (SEQ ID NO: 6368):NAIS (SEQ ID NO: 6357), APTKM (SEQ ID NO: 6370):NAIS (SEQ ID NO: 6357), APTKL (SEQ ID NO: 6369):NAIS (SEQ ID NO: 6357), APTRL (SEQ ID NO: 6373):NAIS (SEQ ID NO: 6357), APTKT (SEQ ID NO: 6371):NAIS (SEQ ID NO: 6357), APTAL (SEQ ID NO: 6366):NAIS (SEQ ID NO: 6357), APTDL (SEQ ID NO: 6367):NAIS (SEQ ID NO: 6357), VPTEL (SEQ ID NO: 6421):NAIS (SEQ ID NO: 6357), VPEKM (SEQ ID NO: 6406):NAIS (SEQ ID NO: 6357), VPTKL (SEQ ID NO: 6423):NAIS (SEQ ID NO: 6357), TPTKM (SEQ ID NO: 6388):NAIS (SEQ ID NO: 6357), VPARL (SEQ ID NO: 6401):NAIS (SEQ ID NO: 6357), VPTRL (SEQ ID NO: 6427):NAIS (SEQ ID NO: 6357), APVKT (SEQ ID NO: 6379):NAIS (SEQ ID NO: 6357), VPQAL (SEQ ID NO: 6410):NAIS (SEQ ID NO: 6357), VSQDL (SEQ ID NO: 6429):NAIS (SEQ ID NO: 6357), VPQDL (SEQ ID NO: 6411):NAIS (SEQ ID NO: 6357), VPTEE (SEQ ID NO: 6420):NAIS (SEQ ID NO: 6357), VPTGQ (SEQ ID NO: 6422):NAIS (SEQ ID NO: 6357), SRVHH (SEQ ID NO: 6382):NAIS (SEQ ID NO: 6357), TQVQL (SEQ ID NO: 6393):NAIS (SEQ ID NO: 6357), APTEL (SEQ ID NO: 6368):SATS (SEQ ID NO: 6361), APTKM (SEQ ID NO: 6370):SATS (SEQ ID NO: 6361), APTKL (SEQ ID NO: 6369):SATS (SEQ ID NO: 6361), APTQL (SEQ ID NO: 6372):SATS (SEQ ID NO: 6361), APTRL (SEQ ID NO: 6373):SATS (SEQ ID NO: 6361), APTKT (SEQ ID NO: 6371):SATS (SEQ ID NO: 6361), APTAL (SEQ ID NO: 6366):SATS (SEQ ID NO: 6361), APTDL (SEQ ID NO: 6367):SATS (SEQ ID NO: 6361), VPTEL (SEQ ID NO: 6421):SATS (SEQ ID NO: 6361), VPEKM (SEQ ID NO: 6406):SATS (SEQ ID NO: 6361), VPTKL (SEQ ID NO: 6423):SATS (SEQ ID NO: 6361), TPTKM (SEQ ID NO: 6388):SATS (SEQ ID NO: 6361), VPARL (SEQ ID NO: 6401):SATS (SEQ ID NO: 6361), VPTRL (SEQ ID NO: 6427):SATS (SEQ ID NO: 6361), APVKT (SEQ ID NO: 6379):SATS (SEQ ID NO: 6361), VPQAL (SEQ ID NO: 6410):SATS (SEQ ID NO: 6361), VSQDL (SEQ ID NO: 6429):SATS (SEQ ID NO: 6361), VPQDL (SEQ ID NO: 6411):SATS (SEQ ID NO: 6361), VPTEE (SEQ ID NO: 6420):SATS (SEQ ID NO: 6361), VPTGQ (SEQ ID NO: 6422):SATS (SEQ ID NO: 6361), SRVHH (SEQ ID NO: 6382):SATS (SEQ ID NO: 6361), TQVQL (SEQ ID NO: 6393):SATS (SEQ ID NO: 6361), VPTEL (SEQ ID NO: 6421):SPIS (SEQ ID NO: 6364), VPTKM (SEQ ID NO: 6424):SPIS (SEQ ID NO: 6364), VPTKL (SEQ ID NO: 6423):SPIS (SEQ ID NO: 6364), VPTQL (SEQ ID NO: 6426):SPIS (SEQ ID NO: 6364), VPTRL (SEQ ID NO: 6427):SPIS (SEQ ID NO: 6364), VPTKT (SEQ ID NO: 6425):SPIS (SEQ ID NO: 6364), VPTAL (SEQ ID NO: 6418):SPIS (SEQ ID NO: 6364), VPTDL (SEQ ID NO: 6419):SPIS (SEQ ID NO: 6364), VPEKM (SEQ ID NO: 6406):SPIS (SEQ ID NO: 6364), APTKL (SEQ ID NO: 6369):SPIS (SEQ ID NO: 6364), APTQL (SEQ ID NO: 6372):SPIS (SEQ ID NO: 6364), TPTKM (SEQ ID NO: 6388):SPIS (SEQ ID NO: 6364), VPARL (SEQ ID NO: 6401):SPIS (SEQ ID NO: 6364), APVKT (SEQ ID NO: 6379):SPIS (SEQ ID NO: 6364), VPQAL (SEQ ID NO: 6410):SPIS (SEQ ID NO: 6364), VSQDL (SEQ ID NO: 6429):SPIS (SEQ ID NO: 6364), VPQDL (SEQ ID NO: 6411):SPIS (SEQ ID NO: 6364), SRVHH (SEQ ID NO: 6382):SPIS (SEQ ID NO: 6364), TQVQL (SEQ ID NO: 6393):SPIS (SEQ ID NO: 6364), VPTEL (SEQ ID NO: 6421):EPIS (SEQ ID NO: 6353), VPTKM (SEQ ID NO: 6424):EPIS (SEQ ID NO: 6353), VPTKL (SEQ ID NO: 6423):EPIS (SEQ ID NO: 6353), VPTQL (SEQ ID NO: 6426):EPIS (SEQ ID NO: 6353), VPTRL (SEQ ID NO: 6427):EPIS (SEQ ID NO: 6353), VPTKT (SEQ ID NO: 6425):EPIS (SEQ ID NO: 6353), VPTAL (SEQ ID NO: 6418):EPIS (SEQ ID NO: 6353), VPTDL (SEQ ID NO: 6419):EPIS (SEQ ID NO: 6353), VPEKM (SEQ ID NO: 6406):EPIS (SEQ ID NO: 6353), APTKL (SEQ ID NO: 6369):EPIS (SEQ ID NO: 6353), APTQL (SEQ ID NO: 6372):EPIS (SEQ ID NO: 6353), TPTKM (SEQ ID NO: 6388):EPIS (SEQ ID NO: 6353), VPARL (SEQ ID NO: 6401):EPIS (SEQ ID NO: 6353), APVKT (SEQ ID NO: 6379):EPIS (SEQ ID NO: 6353), VPQAL (SEQ ID NO: 6410):EPIS (SEQ ID NO: 6353), VSQDL (SEQ ID NO: 6429):EPIS (SEQ ID NO: 6353), VPQDL (SEQ ID NO: 6411):EPIS (SEQ ID NO: 6353), SRVHH (SEQ ID NO: 6382):EPIS (SEQ ID NO: 6353), TQVQL (SEQ ID NO: 6393):EPIS (SEQ ID NO: 6353), TPTEL (SEQ ID NO: 6386):SPIN (SEQ ID NO: 6363), TPTKM (SEQ ID NO: 6388):SPIN (SEQ ID NO: 6363), TPTKL (SEQ ID NO: 6387):SPIN (SEQ ID NO: 6363), TPTQL (SEQ ID NO: 6390):SPIN (SEQ ID NO: 6363), TPTRL (SEQ ID NO: 6391):SPIN (SEQ ID NO: 6363), TPTKT (SEQ ID NO: 6389):SPIN (SEQ ID NO: 6363), TPTAL (SEQ ID NO: 6384):SPIN (SEQ ID NO: 6363), TPTDL (SEQ ID NO: 6385):SPIN (SEQ ID NO: 6363), VPTEL (SEQ ID NO: 6421):SPIN (SEQ ID NO: 6363), VPEKM (SEQ ID NO: 6406):SPIN (SEQ ID NO: 6363), APTKL (SEQ ID NO: 6369):SPIN (SEQ ID NO: 6363), APTQL (SEQ ID NO: 6372):SPIN (SEQ ID NO: 6363), VPTKL (SEQ ID NO: 6423):SPIN (SEQ ID NO: 6363), VPARL (SEQ ID NO: 6401):SPIN (SEQ ID NO: 6363), VPTRL (SEQ ID NO: 6427):SPIN (SEQ ID NO: 6363), APVKT (SEQ ID NO: 6379):SPIN (SEQ ID NO: 6363), VPQAL (SEQ ID NO: 6410):SPIN (SEQ ID NO: 6363), VSQDL (SEQ ID NO: 6429):SPIN (SEQ ID NO: 6363), VPQDL (SEQ ID NO: 6411):SPIN (SEQ ID NO: 6363), VPTEE (SEQ ID NO: 6420):SPIN (SEQ ID NO: 6363), VPTGQ (SEQ ID NO: 6422):SPIN (SEQ ID NO: 6363), SRVHH (SEQ ID NO: 6382):SPIN (SEQ ID NO: 6363), TQVQL (SEQ ID NO: 6393):SPIN (SEQ ID NO: 6363), VPAEL (SEQ ID NO: 6396):SPIS (SEQ ID NO: 6364), VPAKM (SEQ ID NO: 6398):SPIS (SEQ ID NO: 6364), VPAKL (SEQ ID NO: 6397):SPIS (SEQ ID NO: 6364), VPAQL (SEQ ID NO: 6400):SPIS (SEQ ID NO: 6364), VPAKT (SEQ ID NO: 6399):SPIS (SEQ ID NO: 6364), VPAAL (SEQ ID NO: 6394):SPIS (SEQ ID NO: 6364), VPADL (SEQ ID NO: 6395):SPIS (SEQ ID NO: 6364), VPTEE (SEQ ID NO: 6420):SPIS (SEQ ID NO: 6364), VPTGQ (SEQ ID NO: 6422):SPIS (SEQ ID NO: 6364), APVEL (SEQ ID NO: 6376):KPLS (SEQ ID NO: 6356), APVKM (SEQ ID NO: 6378):KPLS (SEQ ID NO: 6356), APVKL (SEQ ID NO:

6377):KPLS (SEQ ID NO: 6356), APVQL (SEQ ID NO: 6380):KPLS (SEQ ID NO: 6356), APVRL (SEQ ID NO: 6381):KPLS (SEQ ID NO: 6356), APVAL (SEQ ID NO: 6374):KPLS (SEQ ID NO: 6356), APVDL (SEQ ID NO: 6375):KPLS (SEQ ID NO: 6356), VPTEL (SEQ ID NO: 6421):KPLS (SEQ ID NO: 6356), VPEKM (SEQ ID NO: 6406):KPLS (SEQ ID NO: 6356), APTKL (SEQ ID NO: 6369):KPLS (SEQ ID NO: 6356), APTQL (SEQ ID NO: 6372):KPLS (SEQ ID NO: 6356), VPTKL (SEQ ID NO: 6423):KPLS (SEQ ID NO: 6356), TPTKM (SEQ ID NO: 6388):KPLS (SEQ ID NO: 6356), VPARL (SEQ ID NO: 6401):KPLS (SEQ ID NO: 6356), VPTRL (SEQ ID NO: 6427):KPLS (SEQ ID NO: 6356), VPQAL (SEQ ID NO: 6410):KPLS (SEQ ID NO: 6356), VSQDL (SEQ ID NO: 6429):KPLS (SEQ ID NO: 6356), VPQDL (SEQ ID NO: 6411):KPLS (SEQ ID NO: 6356), VPTEE (SEQ ID NO: 6420):KPLS (SEQ ID NO: 6356), VPTGQ (SEQ ID NO: 6422):KPLS (SEQ ID NO: 6356), SRVHH (SEQ ID NO: 6382):KPLS (SEQ ID NO: 6356), TQVQL (SEQ ID NO: 6393):KPLS (SEQ ID NO: 6356), VPQEL (SEQ ID NO: 6412):EPLP (SEQ ID NO: 6354), VPQKM (SEQ ID NO: 6414):EPLP (SEQ ID NO: 6354), VPQKL (SEQ ID NO: 6413):EPLP (SEQ ID NO: 6354), VPQQL (SEQ ID NO: 6416):EPLP (SEQ ID NO: 6354), VPQRL (SEQ ID NO: 6417):EPLP (SEQ ID NO: 6354), VPQKT (SEQ ID NO: 6415):EPLP (SEQ ID NO: 6354), VPQDL (SEQ ID NO: 6411):EPLP (SEQ ID NO: 6354), VPTEL (SEQ ID NO: 6421):EPLP (SEQ ID NO: 6354), VPEKM (SEQ ID NO: 6406):EPLP (SEQ ID NO: 6354), APTKL (SEQ ID NO: 6369):EPLP (SEQ ID NO: 6354), APTQL (SEQ ID NO: 6372):EPLP (SEQ ID NO: 6354), VPTKL (SEQ ID NO: 6423):EPLP (SEQ ID NO: 6354), TPTKM (SEQ ID NO: 6388):EPLP (SEQ ID NO: 6354), VPARL (SEQ ID NO: 6401):EPLP (SEQ ID NO: 6354), VPTRL (SEQ ID NO: 6427):EPLP (SEQ ID NO: 6354), APVKT (SEQ ID NO: 6379):EPLP (SEQ ID NO: 6354), VSQDL (SEQ ID NO: 6429):EPLP (SEQ ID NO: 6354), VPTEE (SEQ ID NO: 6420):EPLP (SEQ ID NO: 6354), VPTGQ (SEQ ID NO: 6422):EPLP (SEQ ID NO: 6354), SRVHH (SEQ ID NO: 6382):EPLP (SEQ ID NO: 6354), TQVQL (SEQ ID NO: 6393):EPLP (SEQ ID NO: 6354), VSQEL (SEQ ID NO: 6430):EPLT (SEQ ID NO: 6355), VSQKM (SEQ ID NO: 6432):EPLT (SEQ ID NO: 6355), VSQKL (SEQ ID NO: 6431):EPLT (SEQ ID NO: 6355), VSQQL (SEQ ID NO: 6434):EPLT (SEQ ID NO: 6355), VSQRL (SEQ ID NO: 6435):EPLT (SEQ ID NO: 6355), VSQKT (SEQ ID NO: 6433):EPLT (SEQ ID NO: 6355), VSQAL (SEQ ID NO: 6428):EPLT (SEQ ID NO: 6355), VSQDL (SEQ ID NO: 6429):EPLT (SEQ ID NO: 6355), VPTEL (SEQ ID NO: 6421):EPLT (SEQ ID NO: 6355), VPEKM (SEQ ID NO: 6406):EPLT (SEQ ID NO: 6355), APTKL (SEQ ID NO: 6369):EPLT (SEQ ID NO: 6355), APTQL (SEQ ID NO: 6372):EPLT (SEQ ID NO: 6355), VPTKL (SEQ ID NO: 6423):EPLT (SEQ ID NO: 6355), TPTKM (SEQ ID NO: 6388):EPLT (SEQ ID NO: 6355), VPARL (SEQ ID NO: 6401):EPLT (SEQ ID NO: 6355), VPTRL (SEQ ID NO: 6427):EPLT (SEQ ID NO: 6355), APVKT (SEQ ID NO: 6379):EPLT (SEQ ID NO: 6355), VPQAL (SEQ ID NO: 6410):EPLT (SEQ ID NO: 6355), VPTEE (SEQ ID NO: 6420):EPLT (SEQ ID NO: 6355), VPTGQ (SEQ ID NO: 6422):EPLT (SEQ ID NO: 6355), SRVHH (SEQ ID NO: 6382):EPLT (SEQ ID NO: 6355), TQVQL (SEQ ID NO: 6393):EPLT (SEQ ID NO: 6355), VPQEL (SEQ ID NO: 6412):EPLT (SEQ ID NO: 6355), VPQKM (SEQ ID NO: 6414):EPLT (SEQ ID NO: 6355), VPQKL (SEQ ID NO: 6413):EPLT (SEQ ID NO: 6355), VPQQL (SEQ ID NO: 6416):EPLT (SEQ ID NO: 6355), VPQRL (SEQ ID NO: 6417):EPLT (SEQ ID NO: 6355), VPQKT (SEQ ID NO: 6415):EPLT (SEQ ID NO: 6355), VPQDL (SEQ ID NO: 6411):EPLT (SEQ ID NO: 6355), VPTGQ (SEQ ID NO: 6422):SNIT (SEQ ID NO: 6362), VPEKM (SEQ ID NO: 6406):SNIT (SEQ ID NO: 6362), APTKL (SEQ ID NO: 6369):SNIT (SEQ ID NO: 6362), APTQL (SEQ ID NO: 6372):SNIT (SEQ ID NO: 6362), TPTKM (SEQ ID NO: 6388):SNIT (SEQ ID NO: 6362), VPARL (SEQ ID NO: 6401):SNIT (SEQ ID NO: 6362), APVKT (SEQ ID NO: 6379):SNIT (SEQ ID NO: 6362), VPQAL (SEQ ID NO: 6410):SNIT (SEQ ID NO: 6362), VSQDL (SEQ ID NO: 6429):SNIT (SEQ ID NO: 6362), VPQDL (SEQ ID NO: 6411):SNIT (SEQ ID NO: 6362), SRVHH (SEQ ID NO: 6382):SNIT (SEQ ID NO: 6362), TQVQL (SEQ ID NO: 6393):SNIT (SEQ ID NO: 6362), SRVQL (SEQ ID NO: 6383):RSVK (SEQ ID NO: 6359), VPTEL (SEQ ID NO: 6421):RSVK (SEQ ID NO: 6359), VPEKM (SEQ ID NO: 6406):RSVK (SEQ ID NO: 6359), APTKL (SEQ ID NO: 6369):RSVK (SEQ ID NO: 6359), APTQL (SEQ ID NO: 6372):RSVK (SEQ ID NO: 6359), VPTKL (SEQ ID NO: 6423):RSVK (SEQ ID NO: 6359), TPTKM (SEQ ID NO: 6388):RSVK (SEQ ID NO: 6359), VPARL (SEQ ID NO: 6401):RSVK (SEQ ID NO: 6359), VPTRL (SEQ ID NO: 6427):RSVK (SEQ ID NO: 6359), APVKT (SEQ ID NO: 6379):RSVK (SEQ ID NO: 6359), VPQAL (SEQ ID NO: 6410):RSVK (SEQ ID NO: 6359), VSQDL (SEQ ID NO: 6429):RSVK (SEQ ID NO: 6359), VPQDL (SEQ ID NO: 6411):RSVK (SEQ ID NO: 6359), VPTEE (SEQ ID NO: 6420):RSVK (SEQ ID NO: 6359), VPTGQ (SEQ ID NO: 6422):RSVK (SEQ ID NO: 6359), TQVQL (SEQ ID NO: 6393):RSVK (SEQ ID NO: 6359), TQVHH (SEQ ID NO: 6392):RPVQ (SEQ ID NO: 6358), VPTEL (SEQ ID NO: 6421):RPVQ (SEQ ID NO: 6358), VPEKM (SEQ ID NO: 6406):RPVQ (SEQ ID NO: 6358), APTKL (SEQ ID NO: 6369):RPVQ (SEQ ID NO: 6358), APTQL (SEQ ID NO: 6372):RPVQ (SEQ ID NO: 6358), VPTKL (SEQ ID NO: 6423):RPVQ (SEQ ID NO: 6358), TPTKM (SEQ ID NO: 6388):RPVQ (SEQ ID NO: 6358), VPARL (SEQ ID NO: 6401):RPVQ (SEQ ID NO: 6358), VPTRL (SEQ ID NO: 6427):RPVQ (SEQ ID NO: 6358), APVKT (SEQ ID NO: 6379):RPVQ (SEQ ID NO: 6358), VPQAL (SEQ ID NO: 6410):RPVQ (SEQ ID NO: 6358), VSQDL (SEQ ID NO: 6429):RPVQ (SEQ ID NO: 6358), VPQDL (SEQ ID NO: 6411):RPVQ (SEQ ID NO: 6358), VPTEE (SEQ ID NO: 6420):RPVQ (SEQ ID NO: 6358), VPTGQ (SEQ ID NO: 6422):RPVQ (SEQ ID NO: 6358) and SRVHH (SEQ ID NO: 6382):RPVQ (SEQ ID NO: 6358).

In particular, in certain embodiments, the pair PEP7:PEP1 is selected from the group consisting of GIPEPXX (SEQ ID NO: 6440):SAIS (SEQ ID NO: 6360), HVTKPTX (SEQ ID NO: 6443):SAIS (SEQ ID NO: 6360), YVPKPXX (SEQ ID NO: 6454):SAIS (SEQ ID NO: 6360), TVPKPXX (SEQ ID NO: 6453):SAIS (SEQ ID NO: 6360), AVPKAXX (SEQ ID NO: 6439):SAIS (SEQ ID NO: 6360), KVGKAXX (SEQ ID NO: 6446):SAIS (SEQ ID NO: 6360), KASKAXX (SEQ ID NO: 6444):SAIS (SEQ ID NO: 6360), GSAGPXX (SEQ ID NO: 6441):SAIS (SEQ ID NO: 6360), AAPASXX (SEQ ID NO: 6436):SAIS (SEQ ID NO: 6360), STPPTXX (SEQ ID NO: 6452):SAIS (SEQ ID NO: 6360), HVPKPXX (SEQ ID NO: 6442):SAIS (SEQ ID NO: 6360), RVPSTXX (SEQ ID NO: 6449):SAIS (SEQ ID NO: 6360), ASAAPXX (SEQ ID NO: 6437):SAIS (SEQ ID NO: 6360), ASASPXX (SEQ ID NO: 6438):SAIS (SEQ ID NO: 6360), SSVKXQP (SEQ ID NO: 6451):SAIS (SEQ ID NO: 6360), RNVQXRP (SEQ ID NO: 6448):SAIS (SEQ ID NO: 6360), KIPKAXX (SEQ ID NO: 6445):SSLS (SEQ ID NO: 6365), SIPKAXX (SEQ ID NO: 6450):SSLS (SEQ ID NO: 6365), HVTKPTX (SEQ ID NO: 6443):SSLS (SEQ ID NO: 6365), YVPKPXX (SEQ ID NO: 6454):SSLS (SEQ ID NO: 6365), TVPKPXX (SEQ ID NO: 6453):SSLS (SEQ ID NO: 6365), AVPKAXX (SEQ ID NO: 6439):SSLS (SEQ ID NO: 6365), KVGKAXX (SEQ ID NO: 6446):SSLS (SEQ ID NO: 6365), KASKAXX (SEQ ID NO: 6444):SSLS (SEQ ID NO: 6365), GSAGPXX (SEQ ID NO: 6441):SSLS (SEQ ID NO: 6365), AAPASXX (SEQ ID NO: 6436):SSLS (SEQ ID NO: 6365), STPPTXX (SEQ ID NO: 6452):SSLS (SEQ ID NO: 6365), HVPKPXX (SEQ ID NO: 6442):SSLS (SEQ ID NO: 6365), RVPSTXX (SEQ ID NO: 6449):SSLS (SEQ ID NO: 6365), ASAAPXX (SEQ ID NO: 6437):SSLS (SEQ ID NO: 6365), ASASPXX (SEQ ID NO: 6438):SSLS (SEQ ID NO: 6365), NDEGLEX (SEQ ID NO: 6447):SSLS (SEQ ID NO: 6365), SSVKXQP (SEQ ID NO: 6451):SSLS (SEQ ID NO: 6365), RNVQXRP (SEQ ID NO: 6448):SSLS (SEQ ID NO: 6365), KIPKAXX (SEQ ID NO: 6445):NAIS (SEQ ID NO: 6357), GIPEPXX (SEQ ID NO: 6440):NAIS (SEQ ID NO: 6357), SIPKAXX (SEQ ID NO: 6450):NAIS (SEQ ID NO: 6357), AVPKAXX (SEQ ID NO: 6439):NAIS (SEQ ID NO: 6357), KVGKAXX (SEQ ID NO: 6446):NAIS (SEQ ID NO: 6357), KASKAXX (SEQ ID NO: 6444):NAIS (SEQ ID NO: 6357), GSAGPXX (SEQ ID NO: 6441):NAIS (SEQ ID NO: 6357), AAPASXX (SEQ ID NO: 6436):NAIS (SEQ ID NO: 6357), STPPTXX (SEQ ID NO: 6452):NAIS (SEQ ID NO: 6357), RVPSTXX (SEQ ID NO: 6449):NAIS (SEQ ID NO: 6357), ASAAPXX (SEQ ID NO: 6437):NAIS (SEQ ID NO: 6357), ASASPXX (SEQ ID NO: 6438):NAIS (SEQ ID NO: 6357), NDEGLEX (SEQ ID NO: 6447):NAIS (SEQ ID NO: 6357), SSVKXQP (SEQ ID NO: 6451):NAIS (SEQ ID NO: 6357), RNVQXRP (SEQ ID NO: 6448):NAIS (SEQ ID NO: 6357), KIPKAXX (SEQ ID NO: 6445):SATS (SEQ ID NO: 6361), GIPEPXX (SEQ ID NO: 6440):SATS (SEQ ID NO: 6361), SIPKAXX (SEQ ID NO: 6450):SATS (SEQ ID NO: 6361), HVTKPTX (SEQ ID NO: 6443):SATS (SEQ ID NO: 6361), YVPKPXX (SEQ ID NO: 6454):SATS (SEQ ID NO: 6361), TVPKPXX (SEQ ID NO: 6453):SATS (SEQ ID NO: 6361), KVGKAXX (SEQ ID NO: 6446):SATS (SEQ ID NO: 6361), KASKAXX (SEQ ID NO: 6444):SATS (SEQ ID NO: 6361), GSAGPXX (SEQ ID NO: 6441):SATS (SEQ ID NO: 6361), AAPASXX (SEQ ID NO: 6436):SATS (SEQ ID NO: 6361), STPPTXX (SEQ ID NO: 6452):SATS (SEQ ID NO: 6361), HVPKPXX (SEQ ID NO: 6442):SATS (SEQ ID NO: 6361), RVPSTXX (SEQ ID NO: 6449):SATS (SEQ ID NO: 6361), ASAAPXX (SEQ ID NO: 6437):SATS (SEQ ID NO: 6361), ASASPXX (SEQ ID NO: 6438):SATS (SEQ ID NO: 6361), NDEGLEX (SEQ ID NO: 6447):SATS (SEQ ID NO: 6361), SSVKXQP (SEQ ID NO: 6451):SATS (SEQ ID NO: 6361), RNVQXRP (SEQ ID NO: 6448):SATS (SEQ ID NO: 6361), KIPKAXX (SEQ ID NO: 6445):SPIS (SEQ ID NO: 6364), GIPEPXX (SEQ ID NO: 6440):SPIS (SEQ ID NO: 6364), SIPKAXX (SEQ ID NO: 6450):SPIS (SEQ ID NO: 6364), HVTKPTX (SEQ ID NO: 6443):SPIS (SEQ ID NO: 6364), YVPKPXX (SEQ ID NO: 6454):SPIS (SEQ ID NO: 6364), TVPKPXX (SEQ ID NO: 6453):SPIS (SEQ ID NO: 6364), AVPKAXX (SEQ ID NO: 6439):SPIS (SEQ ID NO: 6364), KASKAXX (SEQ ID NO: 6444):SPIS (SEQ ID NO: 6364), GSAGPXX (SEQ ID NO: 6441):SPIS (SEQ ID NO: 6364), AAPASXX (SEQ ID NO: 6436):SPIS (SEQ ID NO: 6364), STPPTXX (SEQ ID NO: 6452):SPIS (SEQ ID NO: 6364), HVPKPXX (SEQ ID NO: 6442):SPIS (SEQ ID NO: 6364), RVPSTXX (SEQ ID NO: 6449):SPIS (SEQ ID NO: 6364), ASAAPXX (SEQ ID NO: 6437):SPIS (SEQ ID NO: 6364), ASASPXX (SEQ ID NO: 6438):SPIS (SEQ ID NO: 6364), SSVKXQP (SEQ ID NO: 6451):SPIS (SEQ ID NO: 6364), RNVQXRP (SEQ ID NO: 6448):SPIS (SEQ ID NO: 6364), KIPKAXX (SEQ ID NO: 6445):EPIS (SEQ ID NO: 6353), GIPEPXX (SEQ ID NO: 6440):EPIS (SEQ ID NO: 6353), SIPKAXX (SEQ ID NO: 6450):EPIS (SEQ ID NO: 6353), HVTKPTX (SEQ ID NO: 6443):EPIS (SEQ ID NO: 6353), YVPKPXX (SEQ ID NO: 6454):EPIS (SEQ ID NO: 6353), TVPKPXX (SEQ ID NO: 6453):EPIS (SEQ ID NO: 6353), AVPKAXX (SEQ ID NO: 6439):EPIS (SEQ ID NO: 6353), KVGKAXX (SEQ ID NO: 6446):EPIS (SEQ ID NO: 6353), GSAGPXX (SEQ ID NO: 6441):EPIS (SEQ ID NO: 6353), AAPASXX (SEQ ID NO: 6436):EPIS (SEQ ID NO: 6353), STPPTXX (SEQ ID NO: 6452):EPIS (SEQ ID NO: 6353), HVPKPXX (SEQ ID NO: 6442):EPIS (SEQ ID NO: 6353), RVPSTXX (SEQ ID NO: 6449):EPIS (SEQ ID NO: 6353), ASAAPXX (SEQ ID NO: 6437):EPIS (SEQ ID NO: 6353), ASASPXX (SEQ ID NO: 6438):EPIS (SEQ ID NO: 6353), SSVKXQP (SEQ ID NO: 6451):EPIS (SEQ ID NO: 6353), RNVQXRP (SEQ ID NO: 6448):EPIS (SEQ ID NO: 6353), KIPKAXX (SEQ ID NO: 6445):SPIN (SEQ ID NO: 6363), GIPEPXX (SEQ ID NO: 6440):SPIN (SEQ ID NO: 6363), SIPKAXX (SEQ ID NO: 6450):SPIN (SEQ ID NO: 6363), HVTKPTX (SEQ ID NO: 6443):SPIN (SEQ ID NO: 6363), YVPKPXX (SEQ ID NO: 6454):SPIN (SEQ ID NO: 6363), TVPKPXX (SEQ ID NO: 6453):SPIN (SEQ ID NO: 6363), AVPKAXX (SEQ ID NO: 6439):SPIN (SEQ ID NO: 6363), KVGKAXX (SEQ ID NO: 6446):SPIN (SEQ ID NO: 6363), KASKAXX (SEQ ID NO: 6444):SPIN (SEQ ID NO: 6363), AAPASXX (SEQ ID NO: 6436):SPIN (SEQ ID NO: 6363), STPPTXX (SEQ ID NO: 6452):SPIN (SEQ ID NO: 6363), HVPKPXX (SEQ ID NO: 6442):SPIN (SEQ ID NO: 6363), RVPSTXX (SEQ ID NO: 6449):SPIN (SEQ ID NO: 6363), ASAAPXX (SEQ ID NO: 6437):SPIN (SEQ ID NO: 6363), ASASPXX (SEQ ID NO: 6438):SPIN (SEQ ID NO: 6363), NDEGLEX (SEQ ID NO: 6447):SPIN (SEQ ID NO: 6363), SSVKXQP (SEQ ID NO: 6451):SPIN (SEQ ID NO: 6363), RNVQXRP (SEQ ID NO: 6448):SPIN (SEQ ID NO: 6363), KVGKAXX (SEQ ID NO: 6446):SPIS (SEQ ID NO: 6364), NDEGLEX (SEQ ID NO: 6447):SPIS (SEQ ID NO: 6364), KIPKAXX (SEQ ID NO: 6445):KPLS (SEQ ID NO: 6356), GIPEPXX (SEQ ID NO: 6440):KPLS (SEQ ID NO: 6356), SIPKAXX (SEQ ID NO: 6450):KPLS (SEQ ID NO: 6356), HVTKPTX (SEQ ID NO: 6443):KPLS (SEQ ID NO: 6356), YVPKPXX (SEQ ID NO: 6454):KPLS (SEQ ID NO: 6356), TVPKPXX (SEQ ID NO: 6453):KPLS (SEQ ID NO: 6356), AVPKAXX (SEQ ID NO: 6439):KPLS (SEQ ID NO: 6356), KVGKAXX (SEQ ID NO: 6446):KPLS (SEQ ID NO: 6356), KASKAXX (SEQ ID NO: 6444):KPLS (SEQ ID NO: 6356), GSAGPXX (SEQ ID NO: 6441):KPLS (SEQ ID NO: 6356), AAPASXX (SEQ ID NO: 6436):KPLS (SEQ ID NO: 6356), STPPTXX (SEQ ID NO: 6452):KPLS (SEQ ID NO: 6356), HVPKPXX (SEQ ID NO: 6442):KPLS (SEQ ID NO: 6356), ASAAPXX (SEQ ID NO: 6437):KPLS (SEQ ID NO: 6356), ASASPXX (SEQ ID NO: 6438):KPLS (SEQ ID NO: 6356), NDEGLEX (SEQ ID NO: 6447):KPLS (SEQ ID NO: 6356), SSVKXQP (SEQ ID NO: 6451):KPLS (SEQ ID NO: 6356), RNVQXRP (SEQ ID NO: 6448):KPLS (SEQ ID NO: 6356), KIPKAXX (SEQ ID NO: 6445):EPLP (SEQ ID NO: 6354), GIPEPXX (SEQ ID NO: 6440):EPLP (SEQ ID NO: 6354), SIPKAXX (SEQ ID NO: 6450):EPLP (SEQ ID NO: 6354), HVTKPTX (SEQ ID NO: 6443):EPLP (SEQ ID NO: 6354), YVPKPXX (SEQ ID NO: 6454):EPLP (SEQ ID NO: 6354), TVPKPXX (SEQ ID NO: 6453):EPLP (SEQ ID NO: 6354), AVPKAXX (SEQ ID NO: 6439):EPLP (SEQ ID NO: 6354), KVGKAXX (SEQ ID NO: 6446):EPLP (SEQ ID NO: 6354), KASKAXX (SEQ ID NO: 6444):EPLP (SEQ ID NO: 6354), GSAGPXX (SEQ ID NO: 6441):EPLP (SEQ ID NO: 6354), AAPASXX (SEQ ID NO: 6436):EPLP (SEQ ID NO: 6354), STPPTXX (SEQ ID NO: 6452):EPLP (SEQ ID NO:

6354), HVPKPXX (SEQ ID NO: 6442):EPLP (SEQ ID NO: 6354), RVPSTXX (SEQ ID NO: 6449):EPLP (SEQ ID NO: 6354), ASASPXX (SEQ ID NO: 6438):EPLP (SEQ ID NO: 6354), NDEGLEX (SEQ ID NO: 6447):EPLP (SEQ ID NO: 6354), SSVKXQP (SEQ ID NO: 6451):EPLP (SEQ ID NO: 6354), RNVQXRP (SEQ ID NO: 6448):EPLP (SEQ ID NO: 6354), KIPKAXX (SEQ ID NO: 6445):EPLT (SEQ ID NO: 6355), GIPEPXX (SEQ ID NO: 6440):EPLT (SEQ ID NO: 6355), SIPKAXX (SEQ ID NO: 6450):EPLT (SEQ ID NO: 6355), HVTKPTX (SEQ ID NO: 6443):EPLT (SEQ ID NO: 6355), YVPKPXX (SEQ ID NO: 6454):EPLT (SEQ ID NO: 6355), TVPKPXX (SEQ ID NO: 6453):EPLT (SEQ ID NO: 6355), AVPKAXX (SEQ ID NO: 6439):EPLT (SEQ ID NO: 6355), KVGKAXX (SEQ ID NO: 6446):EPLT (SEQ ID NO: 6355), KASKAXX (SEQ ID NO: 6444):EPLT (SEQ ID NO: 6355), GSAGPXX (SEQ ID NO: 6441):EPLT (SEQ ID NO: 6355), AAPASXX (SEQ ID NO: 6436):EPLT (SEQ ID NO: 6355), STPPTXX (SEQ ID NO: 6452):EPLT (SEQ ID NO: 6355), HVPKPXX (SEQ ID NO: 6442):EPLT (SEQ ID NO: 6355), RVPSTXX (SEQ ID NO: 6449):EPLT (SEQ ID NO: 6355), ASAAPXX (SEQ ID NO: 6437):EPLT (SEQ ID NO: 6355), ASASPXX (SEQ ID NO: 6438):EPLT (SEQ ID NO: 6355), NDEGLEX (SEQ ID NO: 6447):EPLT (SEQ ID NO: 6355), SSVKXQP (SEQ ID NO: 6451):EPLT (SEQ ID NO: 6355), RNVQXRP (SEQ ID NO: 6448):EPLT (SEQ ID NO: 6355), NDEGLEX (SEQ ID NO: 6447):SNIT (SEQ ID NO: 6362), GIPEPXX (SEQ ID NO: 6440):SNIT (SEQ ID NO: 6362), HVTKPTX (SEQ ID NO: 6443):SNIT (SEQ ID NO: 6362), YVPKPXX (SEQ ID NO: 6454):SNIT (SEQ ID NO: 6362), TVPKPXX (SEQ ID NO: 6453):SNIT (SEQ ID NO: 6362), AVPKAXX (SEQ ID NO: 6439):SNIT (SEQ ID NO: 6362), GSAGPXX (SEQ ID NO: 6441):SN IT (SEQ ID NO: 6362), AAPASXX (SEQ ID NO: 6436):SNIT (SEQ ID NO: 6362), HVPKPXX (SEQ ID NO: 6442):SNIT (SEQ ID NO: 6362), RVPSTXX (SEQ ID NO: 6449):SNIT (SEQ ID NO: 6362), ASAAPXX (SEQ ID NO: 6437):SN IT (SEQ ID NO: 6362), ASASPXX (SEQ ID NO: 6438):SNIT (SEQ ID NO: 6362), SSVKXQP (SEQ ID NO: 6451):SNIT (SEQ ID NO: 6362), RNVQXRP (SEQ ID NO: 6448):SNIT (SEQ ID NO: 6362), RNVQXRP (SEQ ID NO: 6448):RSVK (SEQ ID NO: 6359), KIPKAXX (SEQ ID NO: 6445):RSVK (SEQ ID NO: 6359), GIPEPXX (SEQ ID NO: 6440):RSVK (SEQ ID NO: 6359), SIPKAXX (SEQ ID NO: 6450):RSVK (SEQ ID NO: 6359), HVTKPTX (SEQ ID NO: 6443):RSVK (SEQ ID NO: 6359), YVPKPXX (SEQ ID NO: 6454):RSVK (SEQ ID NO: 6359), TVPKPXX (SEQ ID NO: 6453):RSVK (SEQ ID NO: 6359), AVPKAXX (SEQ ID NO: 6439):RSVK (SEQ ID NO: 6359), KVGKAXX (SEQ ID NO: 6446):RSVK (SEQ ID NO: 6359), KASKAXX (SEQ ID NO: 6444):RSVK (SEQ ID NO: 6359), GSAGPXX (SEQ ID NO: 6441):RSVK (SEQ ID NO: 6359), AAPASXX (SEQ ID NO: 6436):RSVK (SEQ ID NO: 6359), STPPTXX (SEQ ID NO: 6452):RSVK (SEQ ID NO: 6359), HVPKPXX (SEQ ID NO: 6442):RSVK (SEQ ID NO: 6359), RVPSTXX (SEQ ID NO: 6449):RSVK (SEQ ID NO: 6359), ASAAPXX (SEQ ID NO: 6437):RSVK (SEQ ID NO: 6359), ASASPXX (SEQ ID NO: 6438):RSVK (SEQ ID NO: 6359), NDEGLEX (SEQ ID NO: 6447):RSVK (SEQ ID NO: 6359), SSVKXQP (SEQ ID NO: 6451):RPVQ (SEQ ID NO: 6358), KIPKAXX (SEQ ID NO: 6445):RPVQ (SEQ ID NO: 6358), GIPEPXX (SEQ ID NO: 6440):RPVQ (SEQ ID NO: 6358), SIPKAXX (SEQ ID NO: 6450):RPVQ (SEQ ID NO: 6358), HVTKPTX (SEQ ID NO: 6443):RPVQ (SEQ ID NO: 6358), YVPKPXX (SEQ ID NO: 6454):RPVQ (SEQ ID NO: 6358), TVPKPXX (SEQ ID NO: 6453):RPVQ (SEQ ID NO: 6358), AVPKAXX (SEQ ID NO: 6439):RPVQ (SEQ ID NO: 6358), KVGKAXX (SEQ ID NO: 6446):RPVQ (SEQ ID NO: 6358), KASKAXX (SEQ ID NO: 6444):RPVQ (SEQ ID NO: 6358), GSAGPXX (SEQ ID NO: 6441):RPVQ (SEQ ID NO: 6358), AAPASXX (SEQ ID NO: 6436): RPVQ (SEQ ID NO: 6358), STPPTXX (SEQ ID NO: 6452):RPVQ (SEQ ID NO: 6358), HVPKPXX (SEQ ID NO: 6442):RPVQ (SEQ ID NO: 6358), RVPSTXX (SEQ ID NO: 6449):RPVQ (SEQ ID NO: 6358), ASAAPXX (SEQ ID NO: 6437):RPVQ (SEQ ID NO: 6358), ASASPXX (SEQ ID NO: 6438):RPVQ (SEQ ID NO: 6358) and NDEGLEX (SEQ ID NO: 6447):RPVQ (SEQ ID NO: 6358).

In particular, in certain embodiments, the pair PEP9:PEP1 is selected from the group consisting of GIPEPXXVPTKM (SEQ ID NO: 6493):SAIS (SEQ ID NO: 6360), HVTKPTXVPTKL (SEQ ID NO: 6519):SAIS (SEQ ID NO: 6360), YVPKPXXVPTKL (SEQ ID NO: 6589):SAIS (SEQ ID NO: 6360), TVPKPXXVPTQL (SEQ ID NO: 6581):SAIS (SEQ ID NO: 6360), AVPKAXXVPTKL (SEQ ID NO: 6485):SAIS (SEQ ID NO: 6360), KVGKAXXVPTKL (SEQ ID NO: 6543):SAIS (SEQ ID NO: 6360), KASKAXXVPTKL (SEQ ID NO: 6527):SAIS (SEQ ID NO: 6360), GSAGPXXVPTKM (SEQ ID NO: 6501):SAIS (SEQ ID NO: 6360), AAPASXXVPTRL (SEQ ID NO: 6461):SAIS (SEQ ID NO: 6360), STPPTXXVPTRL (SEQ ID NO: 6573):SAIS (SEQ ID NO: 6360), HVPKPXXVPTKL (SEQ ID NO: 6509):SAIS (SEQ ID NO: 6360), RVPSTXXVPTKT (SEQ ID NO: 6555):SAIS (SEQ ID NO: 6360), ASAAPXXVPTAL (SEQ ID NO: 6469):SAIS (SEQ ID NO: 6360), ASASPXXVPTDL (SEQ ID NO: 6477):SAIS (SEQ ID NO: 6360), GIPEPXXVPEKM (SEQ ID NO: 6491):SAIS (SEQ ID NO: 6360), HVTKPTXAPTKL (SEQ ID NO: 6511):SAIS (SEQ ID NO: 6360), YVPKPXXAPTKL (SEQ ID NO: 6583):SAIS (SEQ ID NO: 6360), TVPKPXXAPTQL (SEQ ID NO: 6575): SAIS (SEQ ID NO: 6360), AVPKAXXAPTKL (SEQ ID NO: 6479):SAIS (SEQ ID NO: 6360), GSAGPXXTPTKM (SEQ ID NO: 6497):SAIS (SEQ ID NO: 6360), AAPASXXVPARL (SEQ ID NO: 6458):SAIS (SEQ ID NO: 6360), HVPKPXXAPTKL (SEQ ID NO: 6503):SAIS (SEQ ID NO: 6360), RVPSTXXAPVKT (SEQ ID NO: 6550): SAIS (SEQ ID NO: 6360), ASAAPXXVPQAL (SEQ ID NO: 6468):SAIS (SEQ ID NO: 6360), ASASPXXVSQDL (SEQ ID NO: 6478):SAIS (SEQ ID NO: 6360), ASASPXXVPQDL (SEQ ID NO: 6476):SAIS (SEQ ID NO: 6360), SSVKXQPSRVHH (SEQ ID NO: 6565):SAIS (SEQ ID NO: 6360), RNVQXRPTQVQL (SEQ ID NO: 6548):SAIS (SEQ ID NO: 6360), KIPKAXXVPEEL (SEQ ID NO: 6533):SSLS (SEQ ID NO: 6365), SIPKAXXVPEEL (SEQ ID NO: 6561):SSLS (SEQ ID NO: 6365), HVTKPTXVPEKL (SEQ ID NO: 6517):SSLS (SEQ ID NO: 6365), YVPKPXXVPEKL (SEQ ID NO: 6587): SSLS (SEQ ID NO: 6365), TVPKPXXVPEQL (SEQ ID NO: 6579):SSLS (SEQ ID NO: 6365), AVPKAXXVPEKL (SEQ ID NO: 6483):SSLS (SEQ ID NO: 6365), KVGKAXXVPEKL (SEQ ID NO: 6541):SSLS (SEQ ID NO: 6365), KASKAXXVPEKL (SEQ ID NO: 6525):SSLS (SEQ ID NO: 6365), GSAGPXXVPEKM (SEQ ID NO: 6499):SSLS (SEQ ID NO: 6365), AAPASXXVPERL (SEQ ID NO: 6459):SSLS (SEQ ID NO: 6365), STPPTXXVPERL (SEQ ID NO: 6571):SSLS (SEQ ID NO: 6365), HVPKPXXVPEKL (SEQ ID NO: 6507):SSLS (SEQ ID NO: 6365), RVPSTXXVPEKT (SEQ ID NO: 6553): SSLS (SEQ ID NO: 6365), ASAAPXXVPEAL (SEQ ID NO: 6467):SSLS (SEQ ID NO: 6365), ASASPXXVPEDL (SEQ ID NO: 6475):SSLS (SEQ ID NO: 6365), KIPKAXXVPTEL (SEQ ID NO: 6535):SSLS (SEQ ID NO: 6365), SIPKAXXVPTEL (SEQ ID NO: 6563):SSLS (SEQ ID NO: 6365), HVTKPTXAPTKL (SEQ ID NO: 6511): SSLS (SEQ ID NO: 6365), YVPKPXXAPTKL (SEQ ID NO: 6583):SSLS (SEQ ID NO: 6365), TVPKPXXAPTQL (SEQ ID NO: 6575):SSLS (SEQ ID NO: 6365), AVPKAXXAPTKL (SEQ ID NO: 6479):SSLS (SEQ ID NO: 6365), KVGKAXXVPTKL (SEQ ID NO: 6543):SSLS (SEQ ID NO: 6365), KASKAXXVPTKL (SEQ ID NO: 6527):SSLS (SEQ ID NO: 6365), GSAGPXXTPTKM (SEQ ID NO: 6497):SSLS (SEQ ID NO: 6365), AAPASXXVPARL (SEQ ID NO: 6458):SSLS (SEQ ID NO: 6365), STPPTXXVPTRL (SEQ ID NO: 6573):SSLS (SEQ ID NO: 6365), HVPKPXXAPTKL (SEQ ID NO: 6503):SSLS (SEQ ID NO: 6365), RVPSTXXAPVKT (SEQ ID NO: 6550):SSLS (SEQ ID NO: 6365), ASAAPXXVPQAL (SEQ ID NO: 6468):SSLS (SEQ ID NO: 6365), ASASPXXVSQDL (SEQ ID NO: 6478):SSLS (SEQ ID NO: 6365), ASASPXXVPQDL (SEQ ID NO: 6476):SSLS (SEQ ID NO: 6365), NDEGLEXVPTEE (SEQ ID NO: 6545):SSLS (SEQ ID NO: 6365), NDEGLEXVPTGQ (SEQ ID NO: 6546):SSLS (SEQ ID NO: 6365), SSVKXQPSRVHH (SEQ ID NO: 6565):SSLS (SEQ ID NO: 6365), RNVQXRPTQVQL (SEQ ID NO: 6548): SSLS (SEQ ID NO: 6365), KIPKAXXAPTEL (SEQ ID NO: 6529):NAIS (SEQ ID NO: 6357), GIPEPXXAPTKM (SEQ ID NO: 6487):NAIS (SEQ ID NO: 6357), SIPKAXXAPTEL (SEQ ID NO: 6557):NAIS (SEQ ID NO: 6357), AVPKAXXAPTKL (SEQ ID NO: 6479):NAIS (SEQ ID NO: 6357), KVGKAXXAPTKL (SEQ ID NO: 6537): NAIS (SEQ ID NO: 6357), KASKAXXAPTKL (SEQ ID NO: 6521):NAIS (SEQ ID NO: 6357), GSAGPXXAPTKM (SEQ ID NO: 6495):NAIS (SEQ ID NO: 6357), AAPASXXAPTRL (SEQ ID NO: 6455):NAIS (SEQ ID NO: 6357), STPPTXXAPTRL (SEQ ID NO: 6567):NAIS (SEQ ID NO: 6357), RVPSTXXAPTKT (SEQ ID NO: 6549):NAIS (SEQ ID NO: 6357), ASAAPXXAPTAL (SEQ ID NO: 6463):NAIS (SEQ ID NO: 6357), ASASPXXAPTDL (SEQ ID NO: 6471):NAIS (SEQ ID NO: 6357), KIPKAXXVPTEL (SEQ ID NO: 6535):NAIS (SEQ ID NO: 6357), GIPEPXXVPEKM (SEQ ID NO: 6491):NAIS (SEQ ID NO: 6357), SIPKAXXVPTEL (SEQ ID NO: 6563):NAIS (SEQ ID NO: 6357), KVGKAXXVPTKL (SEQ ID NO: 6543):NAIS (SEQ ID NO: 6357), KASKAXXVPTKL (SEQ ID NO: 6527):NAIS (SEQ ID NO: 6357), GSAGPXXTPTKM (SEQ ID NO: 6497):NAIS (SEQ ID NO: 6357), AAPASXXVPARL (SEQ ID NO: 6458):NAIS (SEQ ID NO: 6357), STPPTXXVPTRL (SEQ ID NO: 6573):NAIS (SEQ ID NO: 6357), RVPSTXXAPVKT (SEQ ID NO: 6550):NAIS (SEQ ID NO: 6357), ASAAPXXVPQAL (SEQ ID NO: 6468):NAIS (SEQ ID NO: 6357), ASASPXXVSQDL (SEQ ID NO: 6478):NAIS (SEQ ID NO: 6357), ASASPXXVPQDL (SEQ ID NO: 6476):NAIS (SEQ ID NO: 6357), NDEGLEXVPTEE (SEQ ID NO: 6545):NAIS (SEQ ID NO: 6357), NDEGLEXVPTGQ (SEQ ID NO: 6546):NAIS (SEQ ID NO: 6357), SSVKXQPSRVHH (SEQ ID NO: 6565):NAIS (SEQ ID NO: 6357), RNVQXRPTQVQL (SEQ ID NO: 6548):NAIS (SEQ ID NO: 6357), KIPKAXXAPTEL (SEQ ID NO: 6529):SATS (SEQ ID NO: 6361), GIPEPXXAPTKM (SEQ ID NO: 6487):SATS (SEQ ID NO: 6361), SIPKAXXAPTEL (SEQ ID NO: 6557):SATS (SEQ ID NO: 6361), HVTKPTXAPTKL (SEQ ID NO: 6511):SATS (SEQ ID NO: 6361), YVPKPXXAPTKL (SEQ ID NO: 6583):SATS (SEQ ID NO: 6361), TVPKPXXAPTQL (SEQ ID NO: 6575):SATS (SEQ ID NO: 6361), KVGKAXXAPTKL (SEQ ID NO: 6537):SATS (SEQ ID NO: 6361), KASKAXXAPTKL (SEQ ID NO: 6521):SATS (SEQ ID NO: 6361), GSAGPXXAPTKM (SEQ ID NO: 6495):SATS (SEQ ID NO: 6361), AAPASXXAPTRL (SEQ ID NO: 6455):SATS (SEQ ID NO: 6361), STPPTXXAPTRL (SEQ ID NO: 6567):SATS (SEQ ID NO: 6361), HVPKPXXAPTKL (SEQ ID NO: 6503):SATS (SEQ ID NO: 6361), RVPSTXXAPTKT (SEQ ID NO: 6549):SATS (SEQ ID NO: 6361), ASAAPXXAPTAL (SEQ ID NO: 6463):SATS (SEQ ID NO: 6361), ASASPXXAPTDL (SEQ ID NO: 6471):SATS (SEQ ID NO: 6361), KIPKAXXVPTEL (SEQ ID NO: 6535):SATS (SEQ ID NO: 6361), GIPEPXXVPEKM (SEQ ID NO: 6491):SATS (SEQ ID NO: 6361), SIPKAXXVPTEL (SEQ ID NO: 6563):SATS (SEQ ID NO: 6361), KVGKAXXVPTKL (SEQ ID NO: 6543):SATS (SEQ ID NO: 6361), KASKAXXVPTKL (SEQ ID NO: 6527):SATS (SEQ ID NO: 6361), GSAGPXXTPTKM (SEQ ID NO: 6497):SATS (SEQ ID NO: 6361), AAPASXXVPARL (SEQ ID NO: 6458):SATS (SEQ ID NO: 6361), STPPTXXVPTRL (SEQ ID NO: 6573):SATS (SEQ ID NO: 6361), RVPSTXXAPVKT (SEQ ID NO: 6550):SATS (SEQ ID NO: 6361), ASAAPXXVPQAL (SEQ ID NO: 6468):SATS (SEQ ID NO: 6361), ASASPXXVSQDL (SEQ ID NO: 6478):SATS (SEQ ID NO: 6361), ASASPXXVPQDL (SEQ ID NO: 6476):SATS (SEQ ID NO: 6361), NDEGLEXVPTEE (SEQ ID NO: 6545):SATS (SEQ ID NO: 6361), NDEGLEXVPTGQ (SEQ ID NO: 6546):SATS (SEQ ID NO: 6361), SSVKXQPSRVHH (SEQ ID NO: 6565):SATS (SEQ ID NO: 6361), RNVQXRPTQVQL (SEQ ID NO: 6548):SATS (SEQ ID NO: 6361), KIPKAXXVPTEL (SEQ ID NO: 6535):SPIS (SEQ ID NO: 6364), GIPEPXXVPTKM (SEQ ID NO: 6493):SPIS (SEQ ID NO: 6364), SIPKAXXVPTEL (SEQ ID NO: 6563):SPIS (SEQ ID NO: 6364), HVTKPTXVPTKL (SEQ ID NO: 6519): SPIS (SEQ ID NO: 6364), YVPKPXXVPTKL (SEQ ID NO: 6589):SPIS (SEQ ID NO: 6364), TVPKPXXVPTQL (SEQ ID NO: 6581):SPIS (SEQ ID NO: 6364), AVPKAXXVPTKL (SEQ ID NO: 6485):SPIS (SEQ ID NO: 6364), KASKAXXVPTKL (SEQ ID NO: 6527):SPIS (SEQ ID NO: 6364), GSAGPXXVPTKM (SEQ ID NO: 6501): SPIS (SEQ ID NO: 6364), AAPASXXVPTRL (SEQ ID NO: 6461):SPIS (SEQ ID NO: 6364), STPPTXXVPTRL (SEQ ID NO: 6573):SPIS (SEQ ID NO: 6364), HVPKPXXVPTKL (SEQ ID NO: 6509):SPIS (SEQ ID NO: 6364), RVPSTXXVPTKT (SEQ ID NO: 6555):SPIS (SEQ ID NO: 6364), ASAAPXXVPTAL (SEQ ID NO: 6469): SPIS (SEQ ID NO: 6364), ASASPXXVPTDL (SEQ ID NO: 6477):SPIS (SEQ ID NO: 6364), GIPEPXXVPEKM (SEQ ID NO: 6491):SPIS (SEQ ID NO: 6364), HVTKPTXAPTKL (SEQ ID NO: 6511):SPIS (SEQ ID NO: 6364), YVPKPXXAPTKL (SEQ ID NO: 6583):SPIS (SEQ ID NO: 6364), TVPKPXXAPTQL (SEQ ID NO: 6575): SPIS (SEQ ID NO: 6364), AVPKAXXAPTKL (SEQ ID NO: 6479):SPIS (SEQ ID NO: 6364), GSAGPXXTPTKM (SEQ ID NO: 6497):SPIS (SEQ ID NO: 6364), AAPASXXVPARL (SEQ ID NO: 6458):SPIS (SEQ ID NO: 6364), HVPKPXXAPTKL (SEQ ID NO: 6503):SPIS (SEQ ID NO: 6364), RVPSTXXAPVKT (SEQ ID NO: 6550): SPIS (SEQ ID NO: 6364), ASAAPXXVPQAL (SEQ ID NO: 6468):SPIS (SEQ ID NO: 6364), ASASPXXVSQDL (SEQ ID NO: 6478):SPIS (SEQ ID NO: 6364), ASASPXXVPQDL (SEQ ID NO: 6476):SPIS (SEQ ID NO: 6364), SSVKXQPSRVHH (SEQ ID NO: 6565):SPIS (SEQ ID NO: 6364), RNVQXRPTQVQL (SEQ ID NO: 6548): SPIS (SEQ ID NO: 6364), KIPKAXXVPTEL (SEQ ID NO: 6535):EPIS (SEQ ID NO: 6353), GIPEPXXVPTKM (SEQ ID NO: 6493):EPIS (SEQ ID NO: 6353), SIPKAXXVPTEL (SEQ ID NO: 6563):EPIS (SEQ ID NO: 6353), HVTKPTXVPTKL (SEQ ID NO: 6519):EPIS (SEQ ID NO:

6353), YVPKPXXVPTKL (SEQ ID NO: 6589):EPIS (SEQ ID NO: 6353), TVPKPXXVPTQL (SEQ ID NO: 6581):EPIS (SEQ ID NO: 6353), AVPKAXXVPTKL (SEQ ID NO: 6485):EPIS (SEQ ID NO: 6353), KVGKAXXVPTKL (SEQ ID NO: 6543):EPIS (SEQ ID NO: 6353), GSAGPXXVPTKM (SEQ ID NO: 6501):EPIS (SEQ ID NO: 6353), AAPASXXVPTRL (SEQ ID NO: 6461):EPIS (SEQ ID NO: 6353), STPPTXXVPTRL (SEQ ID NO: 6573):EPIS (SEQ ID NO: 6353), HVPKPXXVPTKL (SEQ ID NO: 6509):EPIS (SEQ ID NO: 6353), RVPSTXXVPTKT (SEQ ID NO: 6555):EPIS (SEQ ID NO: 6353), ASAAPXXVPTAL (SEQ ID NO: 6469):EPIS (SEQ ID NO: 6353), ASASPXXVPTDL (SEQ ID NO: 6477):EPIS (SEQ ID NO: 6353), GIPEPXXVPEKM (SEQ ID NO: 6491):EPIS (SEQ ID NO: 6353), HVTKPTXAPTKL (SEQ ID NO: 6511):EPIS (SEQ ID NO: 6353), YVPKPXXAPTKL (SEQ ID NO: 6583):EPIS (SEQ ID NO: 6353), TVPKPXXAPTQL (SEQ ID NO: 6575):EPIS (SEQ ID NO: 6353), AVPKAXXAPTKL (SEQ ID NO: 6479):EPIS (SEQ ID NO: 6353), GSAGPXXTPTKM (SEQ ID NO: 6497):EPIS (SEQ ID NO: 6353), AAPASXXVPARL (SEQ ID NO: 6458):EPIS (SEQ ID NO: 6353), HVPKPXXAPTKL (SEQ ID NO: 6503):EPIS (SEQ ID NO: 6353), RVPSTXXAPVKT (SEQ ID NO: 6550):EPIS (SEQ ID NO: 6353), ASAAPXXVPQAL (SEQ ID NO: 6468):EPIS (SEQ ID NO: 6353), ASASPXXVSQDL (SEQ ID NO: 6478):EPIS (SEQ ID NO: 6353), ASASPXXVPQDL (SEQ ID NO: 6476):EPIS (SEQ ID NO: 6353), SSVKXQPSRVHH (SEQ ID NO: 6565):EPIS (SEQ ID NO: 6353), RNVQXRPTQVQL (SEQ ID NO: 6548):EPIS (SEQ ID NO: 6353), KIPKAXXTPTEL (SEQ ID NO: 6531):SPIN (SEQ ID NO: 6363), GIPEPXXTPTKM (SEQ ID NO: 6489):SPIN (SEQ ID NO: 6363), SIPKAXXTPTEL (SEQ ID NO: 6559):SPIN (SEQ ID NO: 6363), HVTKPTXTPTKL (SEQ ID NO: 6514):SPIN (SEQ ID NO: 6363), YVPKPXXTPTKL (SEQ ID NO: 6585):SPIN (SEQ ID NO: 6363), TVPKPXXTPTQL (SEQ ID NO: 6577):SPIN (SEQ ID NO: 6363), AVPKAXXTPTKL (SEQ ID NO: 6481):SPIN (SEQ ID NO: 6363), KVGKAXXTPTKL (SEQ ID NO: 6539):SPIN (SEQ ID NO: 6363), KASKAXXTPTKL (SEQ ID NO: 6523):SPIN (SEQ ID NO: 6363), AAPASXXTPTRL (SEQ ID NO: 6457):SPIN (SEQ ID NO: 6363), STPPTXXTPTRL (SEQ ID NO: 6569):SPIN (SEQ ID NO: 6363), HVPKPXXTPTKL (SEQ ID NO: 6505):SPIN (SEQ ID NO: 6363), RVPSTXXTPTKT (SEQ ID NO: 6551):SPIN (SEQ ID NO: 6363), ASAAPXXTPTAL (SEQ ID NO: 6465):SPIN (SEQ ID NO: 6363), ASASPXXTPTDL (SEQ ID NO: 6473):SPIN (SEQ ID NO: 6363), KIPKAXXVPTEL (SEQ ID NO: 6535):SPIN (SEQ ID NO: 6363), GIPEPXXVPEKM (SEQ ID NO: 6491):SPIN (SEQ ID NO: 6363), SIPKAXXVPTEL (SEQ ID NO: 6563):SPIN (SEQ ID NO: 6363), HVTKPTXAPTKL (SEQ ID NO: 6511):SPIN (SEQ ID NO: 6363), YVPKPXXAPTKL (SEQ ID NO: 6583):SPIN (SEQ ID NO: 6363), TVPKPXXAPTQL (SEQ ID NO: 6575):SPIN (SEQ ID NO: 6363), AVPKAXXAPTKL (SEQ ID NO: 6479):SPIN (SEQ ID NO: 6363), KVGKAXXVPTKL (SEQ ID NO: 6543):SPIN (SEQ ID NO: 6363), KASKAXXVPTKL (SEQ ID NO: 6527):SPIN (SEQ ID NO: 6363), AAPASXXVPARL (SEQ ID NO: 6458):SPIN (SEQ ID NO: 6363), STPPTXXVPTRL (SEQ ID NO: 6573):SPIN (SEQ ID NO: 6363), HVPKPXXAPTKL (SEQ ID NO: 6503):SPIN (SEQ ID NO: 6363), RVPSTXXAPVKT (SEQ ID NO: 6550):SPIN (SEQ ID NO: 6363), ASAAPXXVPQAL (SEQ ID NO: 6468):SPIN (SEQ ID NO: 6363), ASASPXXVSQDL (SEQ ID NO: 6478):SPIN (SEQ ID NO: 6363), ASASPXXVPQDL (SEQ ID NO: 6476):SPIN (SEQ ID NO: 6363), NDEGLEXVPTEE (SEQ ID NO: 6545):SPIN (SEQ ID NO: 6363), NDEGLEXVPTGQ (SEQ ID NO: 6546):SPIN (SEQ ID NO: 6363), SSVKXQPSRVHH (SEQ ID NO: 6565):SPIN (SEQ ID NO: 6363), RNVQXRPTQVQL (SEQ ID NO: 6548):SPIN (SEQ ID NO: 6363), KIPKAXXVPAEL (SEQ ID NO: 6532):SPIS (SEQ ID NO: 6364), GIPEPXXVPAKM (SEQ ID NO: 6490):SPIS (SEQ ID NO: 6364), SIPKAXXVPAEL (SEQ ID NO: 6560):SPIS (SEQ ID NO: 6364), HVTKPTXVPAKL (SEQ ID NO: 6516):SPIS (SEQ ID NO: 6364), YVPKPXXVPAKL (SEQ ID NO: 6586):SPIS (SEQ ID NO: 6364), TVPKPXXVPAQL (SEQ ID NO: 6578):SPIS (SEQ ID NO: 6364), AVPKAXXVPAKL (SEQ ID NO: 6482):SPIS (SEQ ID NO: 6364), KVGKAXXVPAKL (SEQ ID NO: 6540):SPIS (SEQ ID NO: 6364), KASKAXXVPAKL (SEQ ID NO: 6524):SPIS (SEQ ID NO: 6364), GSAGPXXVPAKM (SEQ ID NO: 6498):SPIS (SEQ ID NO: 6364), STPPTXXVPARL (SEQ ID NO: 6570):SPIS (SEQ ID NO: 6364), HVPKPXXVPAKL (SEQ ID NO: 6506):SPIS (SEQ ID NO: 6364), RVPSTXXVPAKT (SEQ ID NO: 6552):SPIS (SEQ ID NO: 6364), ASAAPXXVPAAL (SEQ ID NO: 6466):SPIS (SEQ ID NO: 6364), ASASPXXVPADL (SEQ ID NO: 6474):SPIS (SEQ ID NO: 6364), KVGKAXXVPTKL (SEQ ID NO: 6543):SPIS (SEQ ID NO: 6364), NDEGLEXVPTEE (SEQ ID NO: 6545):SPIS (SEQ ID NO: 6364), NDEGLEXVPTGQ (SEQ ID NO: 6546):SPIS (SEQ ID NO: 6364), KIPKAXXAPVEL (SEQ ID NO: 6530):KPLS (SEQ ID NO: 6356), GIPEPXXAPVKM (SEQ ID NO: 6488):KPLS (SEQ ID NO: 6356), SIPKAXXAPVEL (SEQ ID NO: 6558):KPLS (SEQ ID NO: 6356), HVTKPTXAPVKL (SEQ ID NO: 6512):KPLS (SEQ ID NO: 6356), YVPKPXXAPVKL (SEQ ID NO: 6584):KPLS (SEQ ID NO: 6356), TVPKPXXAPVQL (SEQ ID NO: 6576):KPLS (SEQ ID NO: 6356), AVPKAXXAPVKL (SEQ ID NO: 6480):KPLS (SEQ ID NO: 6356), KVGKAXXAPVKL (SEQ ID NO: 6538):KPLS (SEQ ID NO: 6356), KASKAXXAPVKL (SEQ ID NO: 6522):KPLS (SEQ ID NO: 6356), GSAGPXXAPVKM (SEQ ID NO: 6496):KPLS (SEQ ID NO: 6356), AAPASXXAPVRL (SEQ ID NO: 6456):KPLS (SEQ ID NO: 6356), STPPTXXAPVRL (SEQ ID NO: 6568):KPLS (SEQ ID NO: 6356), HVPKPXXAPVKL (SEQ ID NO: 6504):KPLS (SEQ ID NO: 6356), ASAAPXXAPVAL (SEQ ID NO: 6464):KPLS (SEQ ID NO: 6356), ASASPXXAPVDL (SEQ ID NO: 6472):KPLS (SEQ ID NO: 6356), KIPKAXXVPTEL (SEQ ID NO: 6535):KPLS (SEQ ID NO: 6356), GIPEPXXVPEKM (SEQ ID NO: 6491):KPLS (SEQ ID NO: 6356), SIPKAXXVPTEL (SEQ ID NO: 6563):KPLS (SEQ ID NO: 6356), HVTKPTXAPTKL (SEQ ID NO: 6511):KPLS (SEQ ID NO: 6356), YVPKPXXAPTKL (SEQ ID NO: 6583):KPLS (SEQ ID NO: 6356), TVPKPXXAPTQL (SEQ ID NO: 6575):KPLS (SEQ ID NO: 6356), AVPKAXXAPTKL (SEQ ID NO: 6479):KPLS (SEQ ID NO: 6356), KVGKAXXVPTKL (SEQ ID NO: 6543):KPLS (SEQ ID NO: 6356), KASKAXXVPTKL (SEQ ID NO: 6527):KPLS (SEQ ID NO: 6356), GSAGPXXTPTKM (SEQ ID NO: 6497):KPLS (SEQ ID NO: 6356), AAPASXXVPARL (SEQ ID NO: 6458):KPLS (SEQ ID NO: 6356), STPPTXXVPTRL (SEQ ID NO: 6573):KPLS (SEQ ID NO: 6356), HVPKPXXAPTKL (SEQ ID NO: 6503):KPLS (SEQ ID NO: 6356), ASAAPXXVPQAL (SEQ ID NO: 6468):KPLS (SEQ ID NO: 6356), ASASPXXVSQDL (SEQ ID NO: 6478):KPLS (SEQ ID NO: 6356), ASASPXXVPQDL (SEQ ID NO: 6476):KPLS (SEQ ID NO: 6356), NDEGLEXVPTEE (SEQ ID NO: 6545):KPLS (SEQ ID NO: 6356), NDEGLEXVPTGQ (SEQ ID NO: 6546):KPLS (SEQ ID

NO: 6356), SSVKXQPSRVHH (SEQ ID NO: 6565):KPLS (SEQ ID NO: 6356), RNVQXRPTQVQL (SEQ ID NO: 6548):KPLS (SEQ ID NO: 6356), KIPKAXXVPQEL (SEQ ID NO: 6534):EPLP (SEQ ID NO: 6354), GIPEPXXVPQKM (SEQ ID NO: 6492):EPLP (SEQ ID NO: 6354), SIPKAXXVPQEL (SEQ ID NO: 6562):EPLP (SEQ ID NO: 6354), HVTKPTXVPQKL (SEQ ID NO: 6518):EPLP (SEQ ID NO: 6354), YVPKPXXVPQKL (SEQ ID NO: 6588):EPLP (SEQ ID NO: 6354), TVPKPXXVPQQL (SEQ ID NO: 6580):EPLP (SEQ ID NO: 6354), AVPKAXXVPQKL (SEQ ID NO: 6484):EPLP (SEQ ID NO: 6354), KVGKAXXVPQKL (SEQ ID NO: 6542):EPLP (SEQ ID NO: 6354), KASKAXXVPQKL (SEQ ID NO: 6526):EPLP (SEQ ID NO: 6354), GSAGPXXVPQKM (SEQ ID NO: 6500):EPLP (SEQ ID NO: 6354), AAPASXXVPQRL (SEQ ID NO: 6460):EPLP (SEQ ID NO: 6354), STPPTXXVPQRL (SEQ ID NO: 6572):EPLP (SEQ ID NO: 6354), HVPKPXXVPQKL (SEQ ID NO: 6508):EPLP (SEQ ID NO: 6354), RVPSTXXVPQKT (SEQ ID NO: 6554):EPLP (SEQ ID NO: 6354), ASASPXXVPQDL (SEQ ID NO: 6476):EPLP (SEQ ID NO: 6354), KIPKAXXVPTEL (SEQ ID NO: 6535):EPLP (SEQ ID NO: 6354), GIPEPXXVPEKM (SEQ ID NO: 6491):EPLP (SEQ ID NO: 6354), SIPKAXXVPTEL (SEQ ID NO: 6563):EPLP (SEQ ID NO: 6354), HVTKPTXAPTKL (SEQ ID NO: 6511):EPLP (SEQ ID NO: 6354), YVPKPXXAPTKL (SEQ ID NO: 6583):EPLP (SEQ ID NO: 6354), TVPKPXXAPTQL (SEQ ID NO: 6575):EPLP (SEQ ID NO: 6354), AVPKAXXAPTKL (SEQ ID NO: 6479):EPLP (SEQ ID NO: 6354), KVGKAXXVPTKL (SEQ ID NO: 6543):EPLP (SEQ ID NO: 6354), KASKAXXVPTKL (SEQ ID NO: 6527):EPLP (SEQ ID NO: 6354), GSAGPXXTPTKM (SEQ ID NO: 6497):EPLP (SEQ ID NO: 6354), AAPASXXVPARL (SEQ ID NO: 6458):EPLP (SEQ ID NO: 6354), STPPTXXVPTRL (SEQ ID NO: 6573):EPLP (SEQ ID NO: 6354), HVPKPXXAPTKL (SEQ ID NO: 6503):EPLP (SEQ ID NO: 6354), RVPSTXXAPVKT (SEQ ID NO: 6550):EPLP (SEQ ID NO: 6354), ASASPXXVSQDL (SEQ ID NO: 6478):EPLP (SEQ ID NO: 6354), NDEGLEXVPTEE (SEQ ID NO: 6545):EPLP (SEQ ID NO: 6354), NDEGLEXVPTGQ (SEQ ID NO: 6546):EPLP (SEQ ID NO: 6354), SSVKXQPSRVHH (SEQ ID NO: 6565):EPLP (SEQ ID NO: 6354), RNVQXRPTQVQL (SEQ ID NO: 6548):EPLP (SEQ ID NO: 6354), KIPKAXXVSQEL (SEQ ID NO: 6536):EPLT (SEQ ID NO: 6355), GIPEPXXVSQKM (SEQ ID NO: 6494):EPLT (SEQ ID NO: 6355), SIPKAXXVSQEL (SEQ ID NO: 6564):EPLT (SEQ ID NO: 6355), HVTKPTXVSQKL (SEQ ID NO: 6520):EPLT (SEQ ID NO: 6355), YVPKPXXVSQKL (SEQ ID NO: 6590):EPLT (SEQ ID NO: 6355), TVPKPXXVSQQL (SEQ ID NO: 6582):EPLT (SEQ ID NO: 6355), AVPKAXXVSQKL (SEQ ID NO: 6486):EPLT (SEQ ID NO: 6355), KVGKAXXVSQKL (SEQ ID NO: 6544):EPLT (SEQ ID NO: 6355), KASKAXXVSQKL (SEQ ID NO: 6528):EPLT (SEQ ID NO: 6355), GSAGPXXVSQKM (SEQ ID NO: 6502):EPLT (SEQ ID NO: 6355), AAPASXXVSQRL (SEQ ID NO: 6462):EPLT (SEQ ID NO: 6355), STPPTXXVSQRL (SEQ ID NO: 6574):EPLT (SEQ ID NO: 6355), HVPKPXXVSQKL (SEQ ID NO: 6510):EPLT (SEQ ID NO: 6355), RVPSTXXVSQKT (SEQ ID NO: 6556):EPLT (SEQ ID NO: 6355), ASAAPXXVSQAL (SEQ ID NO: 6470):EPLT (SEQ ID NO: 6355), ASASPXXVSQDL (SEQ ID NO: 6478):EPLT (SEQ ID NO: 6355), KIPKAXXVPTEL (SEQ ID NO: 6535):EPLT (SEQ ID NO: 6355), GIPEPXXVPEKM (SEQ ID NO: 6491):EPLT (SEQ ID NO: 6355), SIPKAXXVPTEL (SEQ ID NO: 6563): EPLT (SEQ ID NO: 6355), HVTKPTXAPTKL (SEQ ID NO: 6511):EPLT (SEQ ID NO: 6355), YVPKPXXAPTKL (SEQ ID NO: 6583):EPLT (SEQ ID NO: 6355), TVPKPXXAPTQL (SEQ ID NO: 6575):EPLT (SEQ ID NO: 6355), AVPKAXXAPTKL (SEQ ID NO: 6479):EPLT (SEQ ID NO: 6355), KVGKAXXVPTKL (SEQ ID NO: 6543):EPLT (SEQ ID NO: 6355), KASKAXXVPTKL (SEQ ID NO: 6527):EPLT (SEQ ID NO: 6355), GSAGPXXTPTKM (SEQ ID NO: 6497):EPLT (SEQ ID NO: 6355), AAPASXXVPARL (SEQ ID NO: 6458):EPLT (SEQ ID NO: 6355), STPPTXXVPTRL (SEQ ID NO: 6573):EPLT (SEQ ID NO: 6355), HVPKPXXAPTKL (SEQ ID NO: 6503):EPLT (SEQ ID NO: 6355), RVPSTXXAPVKT (SEQ ID NO: 6550):EPLT (SEQ ID NO: 6355), ASAAPXXVPQAL (SEQ ID NO: 6468):EPLT (SEQ ID NO: 6355), NDEGLEXVPTEE (SEQ ID NO: 6545): EPLT (SEQ ID NO: 6355), NDEGLEXVPTGQ (SEQ ID NO: 6546):EPLT (SEQ ID NO: 6355), SSVKXQPSRVHH (SEQ ID NO: 6565):EPLT (SEQ ID NO: 6355), RNVQXRPTQVQL (SEQ ID NO: 6548):EPLT (SEQ ID NO: 6355), KIPKAXXVPQEL (SEQ ID NO: 6534):EPLT (SEQ ID NO: 6355), GIPEPXXVPQKM (SEQ ID NO: 6492):EPLT (SEQ ID NO: 6355), SIPKAXXVPQEL (SEQ ID NO: 6562):EPLT (SEQ ID NO: 6355), HVTKPTXVPQKL (SEQ ID NO: 6518):EPLT (SEQ ID NO: 6355), YVPKPXXVPQKL (SEQ ID NO: 6588):EPLT (SEQ ID NO: 6355), TVPKPXXVPQQL (SEQ ID NO: 6580):EPLT (SEQ ID NO: 6355), AVPKAXXVPQKL (SEQ ID NO: 6484):EPLT (SEQ ID NO: 6355), KVGKAXXVPQKL (SEQ ID NO: 6542):EPLT (SEQ ID NO: 6355), KASKAXXVPQKL (SEQ ID NO: 6526):EPLT (SEQ ID NO: 6355), GSAGPXXVPQKM (SEQ ID NO: 6500):EPLT (SEQ ID NO: 6355), AAPASXXVPQRL (SEQ ID NO: 6460):EPLT (SEQ ID NO: 6355), STPPTXXVPQRL (SEQ ID NO: 6572):EPLT (SEQ ID NO: 6355), HVPKPXXVPQKL (SEQ ID NO: 6508):EPLT (SEQ ID NO: 6355), RVPSTXXVPQKT (SEQ ID NO: 6554): EPLT (SEQ ID NO: 6355), ASASPXXVPQDL (SEQ ID NO: 6476):EPLT (SEQ ID NO: 6355), NDEGLEXVPTGQ (SEQ ID NO: 6546):SNIT (SEQ ID NO: 6362), GIPEPXXVPEKM (SEQ ID NO: 6491):SNIT (SEQ ID NO: 6362), HVTKPTXAPTKL (SEQ ID NO: 6511):SNIT (SEQ ID NO: 6362), YVPKPXXAPTKL (SEQ ID NO: 6583):SNIT (SEQ ID NO: 6362), TVPKPXXAPTQL (SEQ ID NO: 6575):SN IT (SEQ ID NO: 6362), AVPKAXXAPTKL (SEQ ID NO: 6479):SNIT (SEQ ID NO: 6362), GSAGPXXTPTKM (SEQ ID NO: 6497):SNIT (SEQ ID NO: 6362), AAPASXXVPARL (SEQ ID NO: 6458):SNIT (SEQ ID NO: 6362), HVPKPXXAPTKL (SEQ ID NO: 6503):SNIT (SEQ ID NO: 6362), RVPSTXXAPVKT (SEQ ID NO: 6550):SNIT (SEQ ID NO: 6362), ASAAPXXVPQAL (SEQ ID NO: 6468):SNIT (SEQ ID NO: 6362), ASASPXXVSQDL (SEQ ID NO: 6478):SNIT (SEQ ID NO: 6362), ASASPXXVPQDL (SEQ ID NO: 6476):SNIT (SEQ ID NO: 6362), SSVKXQPSRVHH (SEQ ID NO: 6565):SNIT (SEQ ID NO: 6362), RNVQXRPTQVQL (SEQ ID NO: 6548):SNIT (SEQ ID NO: 6362), RNVQXRPSRVQL (SEQ ID NO: 6547):RSVK (SEQ ID NO: 6359), KIPKAXXVPTEL (SEQ ID NO: 6535):RSVK (SEQ ID NO: 6359), GIPEPXXVPEKM (SEQ ID NO: 6491):RSVK (SEQ ID NO: 6359), SIPKAXXVPTEL (SEQ ID NO: 6563):RSVK (SEQ ID NO: 6359), HVTKPTXAPTKL (SEQ ID NO: 6511):RSVK (SEQ ID NO: 6359), YVPKPXXAPTKL (SEQ ID NO: 6583):RSVK (SEQ ID NO: 6359), TVPKPXXAPTQL (SEQ ID NO: 6575):RSVK (SEQ ID NO: 6359), AVPKAXXAPTKL (SEQ ID NO: 6479):RSVK (SEQ ID NO: 6359),

KVGKAXXVPTKL (SEQ ID NO: 6543):RSVK (SEQ ID NO: 6359), KASKAXXVPTKL (SEQ ID NO: 6527):RSVK (SEQ ID NO: 6359), GSAGPXXTPTKM (SEQ ID NO: 6497):RSVK (SEQ ID NO: 6359), AAPASXXVPARL (SEQ ID NO: 6458):RSVK (SEQ ID NO: 6359), STPPTXXVP-TRL (SEQ ID NO: 6573):RSVK (SEQ ID NO: 6359), HVPKPXXAPTKL (SEQ ID NO: 6503):RSVK (SEQ ID NO: 6359), RVPSTXXAPVKT (SEQ ID NO: 6550):RSVK (SEQ ID NO: 6359), ASAAPXXVPQAL (SEQ ID NO: 6468):RSVK (SEQ ID NO: 6359), ASASPXXVSQDL (SEQ ID NO: 6478):RSVK (SEQ ID NO: 6359), ASASPXXVPQDL (SEQ ID NO: 6476):RSVK (SEQ ID NO: 6359), NDEGLEXVPTEE (SEQ ID NO: 6545):RSVK (SEQ ID NO: 6359), NDEGLEXVPTGQ (SEQ ID NO: 6546):RSVK (SEQ ID NO: 6359), RNVQXRPTQVQL (SEQ ID NO: 6548):RSVK (SEQ ID NO: 6359), SSVKXQPTQVHH (SEQ ID NO: 6566):RPVQ (SEQ ID NO: 6358), KIPKAXXVPTEL (SEQ ID NO: 6535):RPVQ (SEQ ID NO: 6358), GIPEPXXVPEKM (SEQ ID NO: 6491):RPVQ (SEQ ID NO: 6358), SIPKAXXVPTEL (SEQ ID NO: 6563):RPVQ (SEQ ID NO: 6358), HVTKPTXAPTKL (SEQ ID NO: 6511):RPVQ (SEQ ID NO: 6358), YVPKPXXAPTKL (SEQ ID NO: 6583):RPVQ (SEQ ID NO: 6358), TVPKPXXAPTQL (SEQ ID NO: 6575):RPVQ (SEQ ID NO: 6358), AVPKAXXAPTKL (SEQ ID NO: 6479):RPVQ (SEQ ID NO: 6358), KVGKAXXVPTKL (SEQ ID NO: 6543):RPVQ (SEQ ID NO: 6358), KASKAXXVPTKL (SEQ ID NO: 6527):RPVQ (SEQ ID NO: 6358), GSAGPXXTPTKM (SEQ ID NO: 6497):RPVQ (SEQ ID NO: 6358), AAPASXXVPARL (SEQ ID NO: 6458):RPVQ (SEQ ID NO: 6358), STPPTXXVP-TRL (SEQ ID NO: 6573):RPVQ (SEQ ID NO: 6358), HVPKPXXAPTKL (SEQ ID NO: 6503):RPVQ (SEQ ID NO: 6358), RVPSTXXAPVKT (SEQ ID NO: 6550):RPVQ (SEQ ID NO: 6358), ASAAPXXVPQAL (SEQ ID NO: 6468):RPVQ (SEQ ID NO: 6358), ASASPXXVSQDL (SEQ ID NO: 6478):RPVQ (SEQ ID NO: 6358), ASASPXXVPQDL (SEQ ID NO: 6476):RPVQ (SEQ ID NO: 6358), NDEGLEXVPTEE (SEQ ID NO: 6545):RPVQ (SEQ ID NO: 6358), NDEGLEXVPTGQ (SEQ ID NO: 6546):RPVQ (SEQ ID NO: 6358) and SSVKXQPSRVHH (SEQ ID NO: 6565):RPVQ (SEQ ID NO: 6358).

In particular, in certain embodiments, the pair PEP3:PEP12 is selected from the group consisting of VPT:SAIS-AA17-LYL (SEQ ID NO: 6598), VPE:SAIS-AA17-LYL (SEQ ID NO: 6598), APT:SAIS-AA17-LYL (SEQ ID NO: 6598), TPT:SAIS-AA17-LYL (SEQ ID NO: 6598), VPA:SAIS-AA17-LYL (SEQ ID NO: 6598), APV:SAIS-AA17-LYL (SEQ ID NO: 6598), VPQ:SAIS-AA17-LYL (SEQ ID NO: 6598), VSQ:SAIS-AA17-LYL (SEQ ID NO: 6598), SRV:SAIS-AA17-LYL (SEQ ID NO: 6598), TQV:SAIS-AA17-LYL (SEQ ID NO: 6598), VPE:SSLS-AA17-LFF (SEQ ID NO: 6605), VPT:SSLS-AA17-LFF (SEQ ID NO: 6605), APT:SSLS-AA17-LFF (SEQ ID NO: 6605), TPT:SSLS-AA17-LFF (SEQ ID NO: 6605), VPA:SSLS-AA17-LFF (SEQ ID NO: 6605), APV:SSLS-AA17-LFF (SEQ ID NO: 6605), VPQ:SSLS-AA17-LFF (SEQ ID NO: 6605), VSQ:SSLS-AA17-LFF (SEQ ID NO: 6605), SRV:SSLS-AA17-LFF (SEQ ID NO: 6605), TQV:SSLS-AA17-LFF (SEQ ID NO: 6605), APT:NAIS-AA17-LYF (SEQ ID NO: 6595), VPT:NAIS-AA17-LYF (SEQ ID NO: 6595), VPE:NAIS-AA17-LYF (SEQ ID NO: 6595), TPT:NAIS-AA17-LYF (SEQ ID NO: 6595), VPA:NAIS-AA17-LYF (SEQ ID NO: 6595), APV:NAIS-AA17-LYF (SEQ ID NO: 6595), VPQ:NAIS-AA17-LYF (SEQ ID NO: 6595), VSQ:NAIS-AA17-LYF (SEQ ID NO: 6595), SRV:NAIS-AA17-LYF (SEQ ID NO: 6595), TQV:NAIS-AA17-LYF (SEQ ID NO: 6595), APT:SATS-AA17-LYY (SEQ ID NO: 6599), VPT:SATS-AA17-LYY (SEQ ID NO: 6599), VPE:SATS-AA17-LYY (SEQ ID NO: 6599), TPT:SATS-AA17-LYY (SEQ ID NO: 6599), VPA:SATS-AA17-LYY (SEQ ID NO: 6599), APV:SATS-AA17-LYY (SEQ ID NO: 6599), VPQ:SATS-AA17-LYY (SEQ ID NO: 6599), VSQ:SATS-AA17-LYY (SEQ ID NO: 6599), SRV:SATS-AA17-LYY (SEQ ID NO: 6599), TQV:SATS-AA17-LYY (SEQ ID NO: 6599), VPT:SPIS-AA17-LYK (SEQ ID NO: 6604), VPE:SPIS-AA17-LYK (SEQ ID NO: 6604), APT:SPIS-AA17-LYK (SEQ ID NO: 6604), TPT:SPIS-AA17-LYK (SEQ ID NO: 6604), VPA:SPIS-AA17-LYK (SEQ ID NO: 6604), APV:SPIS-AA17-LYK (SEQ ID NO: 6604), VPQ:SPIS-AA17-LYK (SEQ ID NO: 6604), VSQ:SPIS-AA17-LYK (SEQ ID NO: 6604), SRV:SPIS-AA17-LYK (SEQ ID NO: 6604), TQV:SPIS-AA17-LYK (SEQ ID NO: 6604), VPT:EPIS-AA17-LYL (SEQ ID NO: 6591), VPE:EPIS-AA17-LYL (SEQ ID NO: 6591), APT:EPIS-AA17-LYL (SEQ ID NO: 6591), TPT:EPIS-AA17-LYL (SEQ ID NO: 6591), VPA:EPIS-AA17-LYL (SEQ ID NO: 6591), APV:EPIS-AA17-LYL (SEQ ID NO: 6591), VPQ:EPIS-AA17-LYL (SEQ ID NO: 6591), VSQ:EPIS-AA17-LYL (SEQ ID NO: 6591), SRV:EPIS-AA17-LYL (SEQ ID NO: 6591), TQV:EPIS-AA17-LYL (SEQ ID NO: 6591), TPT:SPIN-AA17-LYF (SEQ ID NO: 6601), VPT:SPIN-AA17-LYF (SEQ ID NO: 6601), VPE:SPIN-AA17-LYF (SEQ ID NO: 6601), APT:SPIN-AA17-LYF (SEQ ID NO: 6601), VPA:SPIN-AA17-LYF (SEQ ID NO: 6601), APV:SPIN-AA17-LYF (SEQ ID NO: 6601), VPQ:SPIN-AA17-LYF (SEQ ID NO: 6601), VSQ:SPIN-AA17-LYF (SEQ ID NO: 6601), SRV:SPIN-AA17-LYF (SEQ ID NO: 6601), TQV:SPIN-AA17-LYF (SEQ ID NO: 6601), VPA:SPIS-AA17-LYI (SEQ ID NO: 6603), VPT:SPIS-AA17-LYI (SEQ ID NO: 6603), VPE:SPIS-AA17-LYI (SEQ ID NO: 6603), APT:SPIS-AA17-LYI (SEQ ID NO: 6603), TPT:SPIS-AA17-LYI (SEQ ID NO: 6603), APV:SPIS-AA17-LYI (SEQ ID NO: 6603), VPQ:SPIS-AA17-LYI (SEQ ID NO: 6603), VSQ:SPIS-AA17-LYI (SEQ ID NO: 6603), SRV:SPIS-AA17-LYI (SEQ ID NO: 6603), TQV:SPIS-AA17-LYI (SEQ ID NO: 6603), VPT:SPIS-AA17-LFI (SEQ ID NO: 6602), VPE:SPIS-AA17-LFI (SEQ ID NO: 6602), APT:SPIS-AA17-LFI (SEQ ID NO: 6602), TPT:SPIS-AA17-LFI (SEQ ID NO: 6602), VPA:SPIS-AA17-LFI (SEQ ID NO: 6602), APV:SPIS-AA17-LFI (SEQ ID NO: 6602), VPQ:SPIS-AA17-LFI (SEQ ID NO: 6602), VSQ:SPIS-AA17-LFI (SEQ ID NO: 6602), SRV:SPIS-AA17-LFI (SEQ ID NO: 6602), TQV:SPIS-AA17-LFI (SEQ ID NO: 6602), APV:KPLS-AA17-LYV (SEQ ID NO: 6594), VPT:KPLS-AA17-LYV (SEQ ID NO: 6594), VPE:KPLS-AA17-LYV (SEQ ID NO: 6594), APT:KPLS-AA17-LYV (SEQ ID NO: 6594), TPT:KPLS-AA17-LYV (SEQ ID NO: 6594), VPA:KPLS-AA17-LYV (SEQ ID NO: 6594), VPQ:KPLS-AA17-LYV (SEQ ID NO: 6594), VSQ:KPLS-AA17-LYV (SEQ ID NO: 6594), SRV:KPLS-AA17-LYV (SEQ ID NO: 6594), TQV:KPLS-AA17-LYV (SEQ ID NO: 6594), VPQ:EPLP-AA17-VYY (SEQ ID NO: 6592), VPT:EPLP-AA17-VYY (SEQ ID NO: 6592), VPE:EPLP-AA17-VYY (SEQ ID NO: 6592), APT:EPLP-AA17-VYY (SEQ ID NO: 6592), TPT:EPLP-AA17-VYY (SEQ ID NO: 6592), VPA:EPLP-AA17-VYY (SEQ ID NO: 6592), APV:EPLP-AA17-VYY (SEQ ID NO: 6592), VSQ:EPLP-AA17-VYY (SEQ ID NO: 6592), SRV:EPLP-AA17-VYY (SEQ ID NO: 6592), TQV:EPLP-AA17-VYY (SEQ ID NO: 6592), VSQ:EPLT-AA17-LYY (SEQ ID NO: 6593), VPT:EPLT-AA17-LYY (SEQ ID NO: 6593), VPE:EPLT-AA17-LYY (SEQ ID NO: 6593), APT:EPLT-AA17-LYY (SEQ ID NO: 6593), TPT:EPLT-AA17-LYY (SEQ ID NO: 6593), VPA:EPLT-AA17-LYY (SEQ ID NO:

6593), APV:EPLT-AA17-LYY (SEQ ID NO: 6593), VPQ: EPLT-AA17-LYY (SEQ ID NO: 6593), SRV:EPLT-AA17-LYY (SEQ ID NO: 6593), TQV:EPLT-AA17-LYY (SEQ ID NO: 6593), VPT:SNIT-AA17-QIM (SEQ ID NO: 6600), VPE:SNIT-AA17-QIM (SEQ ID NO: 6600), APT:SNIT-AA17-QIM (SEQ ID NO: 6600), TPT:SNIT-AA17-QIM (SEQ ID NO: 6600), VPA:SNIT-AA17-QIM (SEQ ID NO: 6600), APV:SNIT-AA17-QIM (SEQ ID NO: 6600), VPQ: SNIT-AA17-QIM (SEQ ID NO: 6600), VSQ:SNIT-AA17-QIM (SEQ ID NO: 6600), SRV:SNIT-AA17-QIM (SEQ ID NO: 6600), TQV:SNIT-AA17-QIM (SEQ ID NO: 6600), SRV:RSVK-AA17-AKV (SEQ ID NO: 6597), VPT:RSVK-AA17-AKV (SEQ ID NO: 6597), VPE:RSVK-AA17-AKV (SEQ ID NO: 6597), APT:RSVK-AA17-AKV (SEQ ID NO: 6597), TPT:RSVK-AA17-AKV (SEQ ID NO: 6597), VPA: RSVK-AA17-AKV (SEQ ID NO: 6597), APV:RSVK-AA17-AKV (SEQ ID NO: 6597), VPQ:RSVK-AA17-AKV (SEQ ID NO: 6597), VSQ:RSVK-AA17-AKV (SEQ ID NO: 6597), TQV:RSVK-AA17-AKV (SEQ ID NO: 6597), TQV:RPVQ-AA17-RKI (SEQ ID NO: 6596), VPT:RPVQ-AA17-RKI (SEQ ID NO: 6596), VPE:RPVQ-AA17-RKI (SEQ ID NO: 6596), APT:RPVQ-AA17-RKI (SEQ ID NO: 6596), TPT:RPVQ-AA17-RKI (SEQ ID NO: 6596), VPA: RPVQ-AA17-RKI (SEQ ID NO: 6596), APV:RPVQ-AA17-RKI (SEQ ID NO: 6596), VPQ:RPVQ-AA17-RKI (SEQ ID NO: 6596), VSQ:RPVQ-AA17-RKI (SEQ ID NO: 6596) and SRV:RPVQ-AA17-RKI (SEQ ID NO: 6596); and wherein $AA^{17}$ is selected from the group consisting of G, A, V, L, I, P, F, M, W, T and S (in particular is selected from the group consisting of M, I, L, V and T).

In particular, in certain embodiments, the pair PEP12: PEP5 is selected from the group consisting of VPTKM (SEQ ID NO: 6424):SAIS-AA17-LYL (SEQ ID NO: 6598), VPTKL (SEQ ID NO: 6423):SAIS-AA17-LYL (SEQ ID NO: 6598), VPTQL (SEQ ID NO: 6426):SAIS-AA17-LYL (SEQ ID NO: 6598), VPTRL (SEQ ID NO: 6427):SAIS-AA17-LYL (SEQ ID NO: 6598), VPTKT (SEQ ID NO: 6425):SAIS-AA17-LYL (SEQ ID NO: 6598), VPTAL (SEQ ID NO: 6418):SAIS-AA17-LYL (SEQ ID NO: 6598), VPTDL (SEQ ID NO: 6419):SAIS-AA17-LYL (SEQ ID NO: 6598), VPEKM (SEQ ID NO: 6406):SAIS-AA17-LYL (SEQ ID NO: 6598), APTKL (SEQ ID NO: 6369):SAIS-AA17-LYL (SEQ ID NO: 6598), APTQL (SEQ ID NO: 6372):SAIS-AA17-LYL (SEQ ID NO: 6598), TPTKM (SEQ ID NO: 6388):SAIS-AA17-LYL (SEQ ID NO: 6598), VPARL (SEQ ID NO: 6401):SAIS-AA17-LYL (SEQ ID NO: 6598), APVKT (SEQ ID NO: 6379):SAIS-AA17-LYL (SEQ ID NO: 6598), VPQAL (SEQ ID NO: 6410):SAIS-AA17-LYL (SEQ ID NO: 6598), VSQDL (SEQ ID NO: 6429):SAIS-AA17-LYL (SEQ ID NO: 6598), VPQDL (SEQ ID NO: 6411):SAIS-AA17-LYL (SEQ ID NO: 6598), SRVHH (SEQ ID NO: 6382):SAIS-AA17-LYL (SEQ ID NO: 6598), TQVQL (SEQ ID NO: 6393):SAIS-AA17-LYL (SEQ ID NO: 6598), VPEEL (SEQ ID NO: 6404):SSLS-AA17-LFF (SEQ ID NO: 6605), VPEKL (SEQ ID NO: 6405):SSLS-AA17-LFF (SEQ ID NO: 6605), VPEQL (SEQ ID NO: 6408):SSLS-AA17-LFF (SEQ ID NO: 6605), VPEKM (SEQ ID NO: 6406):SSLS-AA17-LFF (SEQ ID NO: 6605), VPERL (SEQ ID NO: 6409):SSLS-AA17-LFF (SEQ ID NO: 6605), VPEKT (SEQ ID NO: 6407):SSLS-AA17-LFF (SEQ ID NO: 6605), VPEAL (SEQ ID NO: 6402):SSLS-AA17-LFF (SEQ ID NO: 6605), VPEDL (SEQ ID NO: 6403):SSLS-AA17-LFF (SEQ ID NO: 6605), VPTEL (SEQ ID NO: 6421):SSLS-AA17-LFF (SEQ ID NO: 6605), APTKL (SEQ ID NO: 6369):SSLS-AA17-LFF (SEQ ID NO: 6605), APTQL (SEQ ID NO: 6372):SSLS-AA17-LFF (SEQ ID NO: 6605), VPTKL (SEQ ID NO: 6423):SSLS-AA17-LFF (SEQ ID NO: 6605), TPTKM (SEQ ID NO: 6388):SSLS-AA17-LFF (SEQ ID NO: 6605), VPARL (SEQ ID NO: 6401):SSLS-AA17-LFF (SEQ ID NO: 6605), VPTRL (SEQ ID NO: 6427):SSLS-AA17-LFF (SEQ ID NO: 6605), APVKT (SEQ ID NO: 6379):SSLS-AA17-LFF (SEQ ID NO: 6605), VPQAL (SEQ ID NO: 6410):SSLS-AA17-LFF (SEQ ID NO: 6605), VSQDL (SEQ ID NO: 6429):SSLS-AA17-LFF (SEQ ID NO: 6605), VPQDL (SEQ ID NO: 6411):SSLS-AA17-LFF (SEQ ID NO: 6605), VPTEE (SEQ ID NO: 6420):SSLS-AA17-LFF (SEQ ID NO: 6605), VPTGQ (SEQ ID NO: 6422):SSLS-AA17-LFF (SEQ ID NO: 6605), SRVHH (SEQ ID NO: 6382):SSLS-AA17-LFF (SEQ ID NO: 6605), TQVQL (SEQ ID NO: 6393):SSLS-AA17-LFF (SEQ ID NO: 6605), APTEL (SEQ ID NO: 6368):NAIS-AA17-LYF (SEQ ID NO: 6595), APTKM (SEQ ID NO: 6370):NAIS-AA17-LYF (SEQ ID NO: 6595), APTKL (SEQ ID NO: 6369):NAIS-AA17-LYF (SEQ ID NO: 6595), APTRL (SEQ ID NO: 6373):NAIS-AA17-LYF (SEQ ID NO: 6595), APTKT (SEQ ID NO: 6371):NAIS-AA17-LYF (SEQ ID NO: 6595), APTAL (SEQ ID NO: 6366):NAIS-AA17-LYF (SEQ ID NO: 6595), APTDL (SEQ ID NO: 6367):NAIS-AA17-LYF (SEQ ID NO: 6595), VPTEL (SEQ ID NO: 6421):NAIS-AA17-LYF (SEQ ID NO: 6595), VPEKM (SEQ ID NO: 6406):NAIS-AA17-LYF (SEQ ID NO: 6595), VPTKL (SEQ ID NO: 6423):NAIS-AA17-LYF (SEQ ID NO: 6595), TPTKM (SEQ ID NO: 6388):NAIS-AA17-LYF (SEQ ID NO: 6595), VPARL (SEQ ID NO: 6401):NAIS-AA17-LYF (SEQ ID NO: 6595), VPTRL (SEQ ID NO: 6427):NAIS-AA17-LYF (SEQ ID NO: 6595), APVKT (SEQ ID NO: 6379):NAIS-AA17-LYF (SEQ ID NO: 6595), VPQAL (SEQ ID NO: 6410):NAIS-AA17-LYF (SEQ ID NO: 6595), VSQDL (SEQ ID NO: 6429):NAIS-AA17-LYF (SEQ ID NO: 6595), VPQDL (SEQ ID NO: 6411):NAIS-AA17-LYF (SEQ ID NO: 6595), VPTEE (SEQ ID NO: 6420):NAIS-AA17-LYF (SEQ ID NO: 6595), VPTGQ (SEQ ID NO: 6422):NAIS-AA17-LYF (SEQ ID NO: 6595), SRVHH (SEQ ID NO: 6382):NAIS-AA17-LYF (SEQ ID NO: 6595), TQVQL (SEQ ID NO: 6393):NAIS-AA17-LYF (SEQ ID NO: 6595), APTEL (SEQ ID NO: 6368):SATS-AA17-LYY (SEQ ID NO: 6599), APTKM (SEQ ID NO: 6370):SATS-AA17-LYY (SEQ ID NO: 6599), APTKL (SEQ ID NO: 6369):SATS-AA17-LYY (SEQ ID NO: 6599), APTQL (SEQ ID NO: 6372):SATS-AA17-LYY (SEQ ID NO: 6599), APTRL (SEQ ID NO: 6373):SATS-AA17-LYY (SEQ ID NO: 6599), APTKT (SEQ ID NO: 6371):SATS-AA17-LYY (SEQ ID NO: 6599), APTAL (SEQ ID NO: 6366):SATS-AA17-LYY (SEQ ID NO: 6599), APTDL (SEQ ID NO: 6367):SATS-AA17-LYY (SEQ ID NO: 6599), VPTEL (SEQ ID NO: 6421):SATS-AA17-LYY (SEQ ID NO: 6599), VPEKM (SEQ ID NO: 6406):SATS-AA17-LYY (SEQ ID NO: 6599), VPTKL (SEQ ID NO: 6423):SATS-AA17-LYY (SEQ ID NO: 6599), TPTKM (SEQ ID NO: 6388):SATS-AA17-LYY (SEQ ID NO: 6599), VPARL (SEQ ID NO: 6401):SATS-AA17-LYY (SEQ ID NO: 6599), VPTRL (SEQ ID NO: 6427):SATS-AA17-LYY (SEQ ID NO: 6599), APVKT (SEQ ID NO: 6379):SATS-AA17-LYY (SEQ ID NO: 6599), VPQAL (SEQ ID NO: 6410):SATS-AA17-LYY (SEQ ID NO: 6599), VSQDL (SEQ ID NO: 6429):SATS-AA17-LYY (SEQ ID NO: 6599), VPQDL (SEQ ID NO: 6411):SATS-AA17-LYY (SEQ ID NO: 6599), VPTEE (SEQ ID NO: 6420):SATS-AA17-LYY (SEQ ID NO: 6599), VPTGQ (SEQ ID NO: 6422):SATS-AA17-LYY (SEQ ID NO: 6599), SRVHH (SEQ ID NO: 6382):SATS-AA17-LYY (SEQ ID NO: 6599), TQVQL (SEQ ID NO: 6393):SATS-AA17-LYY (SEQ ID NO: 6599), VPTEL (SEQ ID NO: 6421):SPIS-AA17-LYK (SEQ ID NO: 6604), VPTKM (SEQ ID NO: 6424):SPIS-AA17-LYK (SEQ ID NO: 6604), VPTKL (SEQ ID NO: 6423):SPIS-AA17-LYK (SEQ ID NO: 6604), VPTQL (SEQ ID NO: 6426):SPIS-AA17-LYK (SEQ ID NO: 6604), VPTRL (SEQ ID NO: 6427):SPIS-AA17-LYK (SEQ ID NO: 6604), VPTKT (SEQ ID NO: 6425):SPIS-AA17-LYK (SEQ ID NO: 6604), VPTAL (SEQ ID NO: 6418):SPIS-AA17-LYK (SEQ ID NO: 6604), VPTDL (SEQ ID NO: 6419):SPIS-AA17-LYK (SEQ ID NO: 6604), VPEKM (SEQ ID NO: 6406):SPIS-AA17-LYK (SEQ ID NO: 6604), APTKL (SEQ ID NO: 6369):SPIS-AA17-LYK (SEQ ID NO: 6604), APTQL (SEQ ID NO: 6372):SPIS-AA17-LYK (SEQ ID NO: 6604), TPTKM (SEQ ID NO: 6388):SPIS-AA17-LYK (SEQ ID NO: 6604), VPARL (SEQ ID NO: 6401):SPIS-AA17-LYK (SEQ ID NO: 6604), APVKT (SEQ ID NO: 6379):SPIS-AA17-LYK (SEQ ID NO: 6604), VPQAL (SEQ ID NO: 6410):SPIS-AA17-LYK (SEQ ID NO: 6604), VSQDL (SEQ ID NO: 6429):SPIS-AA17-LYK (SEQ ID NO: 6604), VPQDL (SEQ ID NO: 6411):SPIS-AA17-LYK (SEQ ID NO: 6604), SRVHH (SEQ ID NO: 6382):SPIS-AA17-LYK (SEQ ID NO: 6604), TQVQL (SEQ ID NO: 6393):SPIS-AA17-LYK (SEQ ID NO: 6604), VPTEL (SEQ ID NO: 6421):EPIS-AA17-LYL (SEQ ID NO: 6591), VPTKM (SEQ ID NO: 6424):EPIS-AA17-LYL (SEQ ID NO: 6591), VPTKL (SEQ ID NO: 6423):EPIS-AA17-LYL (SEQ ID NO: 6591), VPTQL (SEQ ID NO: 6426):EPIS-AA17-LYL (SEQ ID NO: 6591), VPTRL (SEQ ID NO: 6427):EPIS-AA17-LYL (SEQ ID NO: 6591), VPTKT (SEQ ID NO: 6425):EPIS-AA17-LYL (SEQ ID NO: 6591), VPTAL (SEQ ID NO: 6418):EPIS-AA17-LYL (SEQ ID NO: 6591), VPTDL (SEQ ID NO: 6419):EPIS-AA17-LYL (SEQ ID NO: 6591), VPEKM (SEQ ID NO: 6406):EPIS-AA17-LYL (SEQ ID NO: 6591), APTKL (SEQ ID NO: 6369):EPIS-AA17-LYL (SEQ ID NO: 6591), APTQL (SEQ ID NO: 6372):EPIS-AA17-LYL (SEQ ID NO: 6591), TPTKM (SEQ ID NO: 6388):EPIS-AA17-LYL (SEQ ID NO: 6591), VPARL (SEQ ID NO: 6401):EPIS-AA17-LYL (SEQ ID NO: 6591), APVKT (SEQ ID NO: 6379):EPIS-AA17-LYL (SEQ ID NO: 6591), VPQAL (SEQ ID NO: 6410):EPIS-AA17-LYL (SEQ ID NO: 6591), VSQDL (SEQ ID NO: 6429):EPIS-AA17-LYL (SEQ ID NO: 6591), VPQDL (SEQ ID NO: 6411):EPIS-AA17-LYL (SEQ ID NO: 6591), SRVHH (SEQ ID NO: 6382):EPIS-AA17-LYL (SEQ ID NO: 6591), TQVQL (SEQ ID NO: 6393):EPIS-AA17-LYL (SEQ ID NO: 6591), TPTEL (SEQ ID NO: 6386):SPIN-AA17-LYF (SEQ ID NO: 6601), TPTKM (SEQ ID NO: 6388):SPIN-AA17-LYF (SEQ ID NO: 6601), TPTKL (SEQ ID NO: 6387):SPIN-AA17-LYF (SEQ ID NO: 6601), TPTQL (SEQ ID NO: 6390):SPIN-AA17-LYF (SEQ ID NO: 6601), TPTRL (SEQ ID NO: 6391):SPIN-AA17-LYF (SEQ ID NO: 6601), TPTKT (SEQ ID NO: 6389):SPIN-AA17-LYF (SEQ ID NO: 6601), TPTAL (SEQ ID NO: 6384):SPIN-AA17-LYF (SEQ ID NO: 6601), TPTDL (SEQ ID NO: 6385):SPIN-AA17-LYF (SEQ ID NO: 6601), VPTEL (SEQ ID NO: 6421):SPIN-AA17-LYF (SEQ ID NO: 6601), VPEKM (SEQ ID NO: 6406):SPIN-AA17-LYF (SEQ ID NO: 6601), APTKL (SEQ ID NO: 6369):SPIN-AA17-LYF (SEQ ID NO: 6601), APTQL (SEQ ID NO: 6372):SPIN-AA17-LYF (SEQ ID NO: 6601), VPTKL (SEQ ID NO: 6423):SPIN-AA17-LYF (SEQ ID NO: 6601), VPARL (SEQ ID NO: 6401):SPIN-AA17-LYF (SEQ ID NO: 6601), VPTRL (SEQ ID NO: 6427):SPIN-AA17-LYF (SEQ ID NO: 6601), APVKT (SEQ ID NO: 6379):SPIN-AA17-LYF (SEQ ID NO: 6601), VPQAL (SEQ ID NO: 6410):SPIN-AA17-LYF (SEQ ID NO: 6601), VSQDL (SEQ ID NO: 6429):SPIN-AA17-LYF (SEQ ID NO: 6601), VPQDL (SEQ ID NO: 6411):SPIN-AA17-LYF (SEQ ID NO: 6601), VPTEE (SEQ ID NO: 6420):SPIN-AA17-LYF (SEQ ID NO: 6601), VPTGQ (SEQ ID NO: 6422):SPIN-AA17-LYF (SEQ ID NO: 6601), SRVHH (SEQ ID NO: 6382):SPIN-AA17-LYF (SEQ ID NO: 6601), TQVQL (SEQ ID NO: 6393):SPIN-AA17-LYF (SEQ ID NO: 6601), VPAEL (SEQ ID NO: 6396):SPIS-AA17-LYI (SEQ ID NO: 6603), VPAKM (SEQ ID NO: 6398):SPIS-AA17-LYI (SEQ ID NO: 6603), VPAKL (SEQ ID NO: 6397):SPIS-AA17-LYI (SEQ ID NO: 6603), VPAQL (SEQ ID NO: 6400):SPIS-AA17-LYI (SEQ ID NO: 6603), VPARL (SEQ ID NO: 6401):SPIS-AA17-LYI (SEQ ID NO: 6603), VPAKT (SEQ ID NO: 6399):SPIS-AA17-LYI (SEQ ID NO: 6603), VPAAL (SEQ ID NO: 6394):SPIS-AA17-LYI (SEQ ID NO: 6603), VPADL (SEQ ID NO: 6395):SPIS-AA17-LYI (SEQ ID NO: 6603), VPTEL (SEQ ID NO: 6421):SPIS-AA17-LYI (SEQ ID NO: 6603), VPEKM (SEQ ID NO: 6406):SPIS-AA17-LYI (SEQ ID NO: 6603), APTKL (SEQ ID NO: 6369):SPIS-AA17-LYI (SEQ ID NO: 6603), APTQL (SEQ ID NO: 6372):SPIS-AA17-LYI (SEQ ID NO: 6603), VPTKL (SEQ ID NO: 6423):SPIS-AA17-LYI (SEQ ID NO: 6603), TPTKM (SEQ ID NO: 6388):SPIS-AA17-LYI (SEQ ID NO: 6603), VPTRL (SEQ ID NO: 6427):SPIS-AA17-LYI (SEQ ID NO: 6603), APVKT (SEQ ID NO: 6379):SPIS-AA17-LYI (SEQ ID NO: 6603), VPQAL (SEQ ID NO: 6410):SPIS-AA17-LYI (SEQ ID NO: 6603), VSQDL (SEQ ID NO: 6429):SPIS-AA17-LYI (SEQ ID NO: 6603), VPQDL (SEQ ID NO: 6411):SPIS-AA17-LYI (SEQ ID NO: 6603), VPTEE (SEQ ID NO: 6420):SPIS-AA17-LYI (SEQ ID NO: 6603), VPTGQ (SEQ ID NO: 6422):SPIS-AA17-LYI (SEQ ID NO: 6603), SRVHH (SEQ ID NO: 6382):SPIS-AA17-LYI (SEQ ID NO: 6603), TQVQL (SEQ ID NO: 6393):SPIS-AA17-LYI (SEQ ID NO: 6603), VPTEL (SEQ ID NO: 6421):SPIS-AA17-LFI (SEQ ID NO: 6602), VPTKM (SEQ ID NO: 6424):SPIS-AA17-LFI (SEQ ID NO: 6602), VPTKL (SEQ ID NO: 6423):SPIS-AA17-LFI (SEQ ID NO: 6602), VPTQL (SEQ ID NO: 6426):SPIS-AA17-LFI (SEQ ID NO: 6602), VPTRL (SEQ ID NO: 6427):SPIS-AA17-LFI (SEQ ID NO: 6602), VPTKT (SEQ ID NO: 6425):SPIS-AA17-LFI (SEQ ID NO: 6602), VPTAL (SEQ ID NO: 6418):SPIS-AA17-LFI (SEQ ID NO: 6602), VPTDL (SEQ ID NO: 6419):SPIS-AA17-LFI (SEQ ID NO: 6602), VPEKM (SEQ ID NO: 6406):SPIS-AA17-LFI (SEQ ID NO: 6602), APTKL (SEQ ID NO: 6369):SPIS-AA17-LFI (SEQ ID NO: 6602), APTQL (SEQ ID NO: 6372):SPIS-AA17-LFI (SEQ ID NO: 6602), TPTKM (SEQ ID NO: 6388):SPIS-AA17-LFI (SEQ ID NO: 6602), VPARL (SEQ ID NO: 6401):SPIS-AA17-LFI (SEQ ID NO: 6602), APVKT (SEQ ID NO: 6379):SPIS-AA17-LFI (SEQ ID NO: 6602), VPQAL (SEQ ID NO: 6410):SPIS-AA17-LFI (SEQ ID NO: 6602), VSQDL (SEQ ID NO: 6429):SPIS-AA17-LFI (SEQ ID NO: 6602), VPQDL (SEQ ID NO: 6411):SPIS-AA17-LFI (SEQ ID NO: 6602), SRVHH (SEQ ID NO: 6382):SPIS-AA17-LFI (SEQ ID NO: 6602), TQVQL (SEQ ID NO: 6393):SPIS-AA17-LFI (SEQ ID NO: 6602), APVEL (SEQ ID NO: 6376):KPLS-AA17-LYV (SEQ ID NO: 6594), APVKM (SEQ ID NO: 6378):KPLS-AA17-LYV (SEQ ID NO: 6594), APVKL (SEQ ID NO: 6377):KPLS-AA17-LYV (SEQ ID NO: 6594), APVQL (SEQ ID NO: 6380):KPLS-AA17-LYV (SEQ ID NO: 6594), APVRL (SEQ ID NO: 6381):KPLS-AA17-LYV (SEQ ID NO: 6594), APVAL (SEQ ID NO: 6374):KPLS-AA17-LYV (SEQ ID NO: 6594), APVDL (SEQ ID NO: 6375):KPLS-AA17-LYV (SEQ ID NO: 6594), VPTEL (SEQ ID NO: 6421):KPLS-AA17-LYV (SEQ ID NO: 6594), VPEKM (SEQ ID NO: 6406):KPLS-AA17-LYV (SEQ ID NO: 6594), APTKL (SEQ ID NO: 6369):KPLS-AA17-LYV (SEQ ID NO: 6594), APTQL (SEQ ID NO:

6372):KPLS-AA17-LYV (SEQ ID NO: 6594), VPTKL (SEQ ID NO: 6423):KPLS-AA17-LYV (SEQ ID NO: 6594), TPTKM (SEQ ID NO: 6388):KPLS-AA17-LYV (SEQ ID NO: 6594), VPARL (SEQ ID NO: 6401):KPLS-AA17-LYV (SEQ ID NO: 6594), VPTRL (SEQ ID NO: 6427):KPLS-AA17-LYV (SEQ ID NO: 6594), VPQAL (SEQ ID NO: 6410):KPLS-AA17-LYV (SEQ ID NO: 6594), VSQDL (SEQ ID NO: 6429):KPLS-AA17-LYV (SEQ ID NO: 6594), VPQDL (SEQ ID NO: 6411):KPLS-AA17-LYV (SEQ ID NO: 6594), VPTEE (SEQ ID NO: 6420):KPLS-AA17-LYV (SEQ ID NO: 6594), VPTGQ (SEQ ID NO: 6422):KPLS-AA17-LYV (SEQ ID NO: 6594), SRVHH (SEQ ID NO: 6382):KPLS-AA17-LYV (SEQ ID NO: 6594), TQVQL (SEQ ID NO: 6393):KPLS-AA17-LYV (SEQ ID NO: 6594), VPQEL (SEQ ID NO: 6412):EPLP-AA17-VYY (SEQ ID NO: 6592), VPQKM (SEQ ID NO: 6414):EPLP-AA17-VYY (SEQ ID NO: 6592), VPQKL (SEQ ID NO: 6413):EPLP-AA17-VYY (SEQ ID NO: 6592), VPQQL (SEQ ID NO: 6416):EPLP-AA17-VYY (SEQ ID NO: 6592), VPQRL (SEQ ID NO: 6417):EPLP-AA17-VYY (SEQ ID NO: 6592), VPQKT (SEQ ID NO: 6415):EPLP-AA17-VYY (SEQ ID NO: 6592), VPQDL (SEQ ID NO: 6411):EPLP-AA17-VYY (SEQ ID NO: 6592), VPTEL (SEQ ID NO: 6421):EPLP-AA17-VYY (SEQ ID NO: 6592), VPEKM (SEQ ID NO: 6406):EPLP-AA17-VYY (SEQ ID NO: 6592), APTKL (SEQ ID NO: 6369):EPLP-AA17-VYY (SEQ ID NO: 6592), APTQL (SEQ ID NO: 6372):EPLP-AA17-VYY (SEQ ID NO: 6592), VPTKL (SEQ ID NO: 6423):EPLP-AA17-VYY (SEQ ID NO: 6592), TPTKM (SEQ ID NO: 6388):EPLP-AA17-VYY (SEQ ID NO: 6592), VPARL (SEQ ID NO: 6401):EPLP-AA17-VYY (SEQ ID NO: 6592), VPTRL (SEQ ID NO: 6427):EPLP-AA17-VYY (SEQ ID NO: 6592), APVKT (SEQ ID NO: 6379):EPLP-AA17-VYY (SEQ ID NO: 6592), VSQDL (SEQ ID NO: 6429):EPLP-AA17-VYY (SEQ ID NO: 6592), VPTEE (SEQ ID NO: 6420):EPLP-AA17-VYY (SEQ ID NO: 6592), VPTGQ (SEQ ID NO: 6422):EPLP-AA17-VYY (SEQ ID NO: 6592), SRVHH (SEQ ID NO: 6382):EPLP-AA17-VYY (SEQ ID NO: 6592), TQVQL (SEQ ID NO: 6393):EPLP-AA17-VYY (SEQ ID NO: 6592), VSQEL (SEQ ID NO: 6430):EPLT-AA17-LYY (SEQ ID NO: 6593), VSQKM (SEQ ID NO: 6432):EPLT-AA17-LYY (SEQ ID NO: 6593), VSQKL (SEQ ID NO: 6431):EPLT-AA17-LYY (SEQ ID NO: 6593), VSQQL (SEQ ID NO: 6434):EPLT-AA17-LYY (SEQ ID NO: 6593), VSQRL (SEQ ID NO: 6435):EPLT-AA17-LYY (SEQ ID NO: 6593), VSQKT (SEQ ID NO: 6433):EPLT-AA17-LYY (SEQ ID NO: 6593), VSQAL (SEQ ID NO: 6428):EPLT-AA17-LYY (SEQ ID NO: 6593), VSQDL (SEQ ID NO: 6429):EPLT-AA17-LYY (SEQ ID NO: 6593), VPTEL (SEQ ID NO: 6421):EPLT-AA17-LYY (SEQ ID NO: 6593), VPEKM (SEQ ID NO: 6406):EPLT-AA17-LYY (SEQ ID NO: 6593), APTKL (SEQ ID NO: 6369):EPLT-AA17-LYY (SEQ ID NO: 6593), APTQL (SEQ ID NO: 6372):EPLT-AA17-LYY (SEQ ID NO: 6593), VPTKL (SEQ ID NO: 6423):EPLT-AA17-LYY (SEQ ID NO: 6593), TPTKM (SEQ ID NO: 6388):EPLT-AA17-LYY (SEQ ID NO: 6593), VPARL (SEQ ID NO: 6401):EPLT-AA17-LYY (SEQ ID NO: 6593), VPTRL (SEQ ID NO: 6427):EPLT-AA17-LYY (SEQ ID NO: 6593), APVKT (SEQ ID NO: 6379):EPLT-AA17-LYY (SEQ ID NO: 6593), VPQAL (SEQ ID NO: 6410):EPLT-AA17-LYY (SEQ ID NO: 6593), VPTEE (SEQ ID NO: 6420):EPLT-AA17-LYY (SEQ ID NO: 6593), VPTGQ (SEQ ID NO: 6422):EPLT-AA17-LYY (SEQ ID NO: 6593), SRVHH (SEQ ID NO: 6382):EPLT-AA17-LYY (SEQ ID NO: 6593), TQVQL (SEQ ID NO: 6393):EPLT-AA17-LYY (SEQ ID NO: 6593), VPQEL (SEQ ID NO: 6412):EPLT-AA17-LYY (SEQ ID NO: 6593), VPQKM (SEQ ID NO: 6414):EPLT-AA17-LYY (SEQ ID NO: 6593), VPQKL (SEQ ID NO: 6413):EPLT-AA17-LYY (SEQ ID NO: 6593), VPQQL (SEQ ID NO: 6416):EPLT-AA17-LYY (SEQ ID NO: 6593), VPQRL (SEQ ID NO: 6417):EPLT-AA17-LYY (SEQ ID NO: 6593), VPQKT (SEQ ID NO: 6415):EPLT-AA17-LYY (SEQ ID NO: 6593), VPQDL (SEQ ID NO: 6411):EPLT-AA17-LYY (SEQ ID NO: 6593), VPTGQ (SEQ ID NO: 6422):SNIT-AA17-QIM (SEQ ID NO: 6600), VPEKM (SEQ ID NO: 6406):SNIT-AA17-QIM (SEQ ID NO: 6600), APTKL (SEQ ID NO: 6369):SNIT-AA17-QIM (SEQ ID NO: 6600), APTQL (SEQ ID NO: 6372):SNIT-AA17-QIM (SEQ ID NO: 6600), TPTKM (SEQ ID NO: 6388):SNIT-AA17-QIM (SEQ ID NO: 6600), VPARL (SEQ ID NO: 6401):SNIT-AA17-QIM (SEQ ID NO: 6600), APVKT (SEQ ID NO: 6379):SNIT-AA17-QIM (SEQ ID NO: 6600), VPQAL (SEQ ID NO: 6410):SNIT-AA17-QIM (SEQ ID NO: 6600), VSQDL (SEQ ID NO: 6429):SNIT-AA17-QIM (SEQ ID NO: 6600), VPQDL (SEQ ID NO: 6411):SNIT-AA17-QIM (SEQ ID NO: 6600), SRVHH (SEQ ID NO: 6382):SNIT-AA17-QIM (SEQ ID NO: 6600), TQVQL (SEQ ID NO: 6393):SNIT-AA17-QIM (SEQ ID NO: 6600), SRVQL (SEQ ID NO: 6383):RSVK-AA17-AKV (SEQ ID NO: 6597), VPTEL (SEQ ID NO: 6421):RSVK-AA17-AKV (SEQ ID NO: 6597), VPEKM (SEQ ID NO: 6406):RSVK-AA17-AKV (SEQ ID NO: 6597), APTKL (SEQ ID NO: 6369):RSVK-AA17-AKV (SEQ ID NO: 6597), APTQL (SEQ ID NO: 6372):RSVK-AA17-AKV (SEQ ID NO: 6597), VPTKL (SEQ ID NO: 6423):RSVK-AA17-AKV (SEQ ID NO: 6597), TPTKM (SEQ ID NO: 6388):RSVK-AA17-AKV (SEQ ID NO: 6597), VPARL (SEQ ID NO: 6401):RSVK-AA17-AKV (SEQ ID NO: 6597), VPTRL (SEQ ID NO: 6427):RSVK-AA17-AKV (SEQ ID NO: 6597), APVKT (SEQ ID NO: 6379):RSVK-AA17-AKV (SEQ ID NO: 6597), VPQAL (SEQ ID NO: 6410):RSVK-AA17-AKV (SEQ ID NO: 6597), VSQDL (SEQ ID NO: 6429):RSVK-AA17-AKV (SEQ ID NO: 6597), VPQDL (SEQ ID NO: 6411):RSVK-AA17-AKV (SEQ ID NO: 6597), VPTEE (SEQ ID NO: 6420):RSVK-AA17-AKV (SEQ ID NO: 6597), VPTGQ (SEQ ID NO: 6422):RSVK-AA17-AKV (SEQ ID NO: 6597), TQVQL (SEQ ID NO: 6393):RSVK-AA17-AKV (SEQ ID NO: 6597), TQVHH (SEQ ID NO: 6392):RPVQ-AA17-RKI (SEQ ID NO: 6596), VPTEL (SEQ ID NO: 6421):RPVQ-AA17-RKI (SEQ ID NO: 6596), VPEKM (SEQ ID NO: 6406):RPVQ-AA17-RKI (SEQ ID NO: 6596), APTKL (SEQ ID NO: 6369):RPVQ-AA17-RKI (SEQ ID NO: 6596), APTQL (SEQ ID NO: 6372):RPVQ-AA17-RKI (SEQ ID NO: 6596), VPTKL (SEQ ID NO: 6423):RPVQ-AA17-RKI (SEQ ID NO: 6596), TPTKM (SEQ ID NO: 6388):RPVQ-AA17-RKI (SEQ ID NO: 6596), VPARL (SEQ ID NO: 6401):RPVQ-AA17-RKI (SEQ ID NO: 6596), VPTRL (SEQ ID NO: 6427):RPVQ-AA17-RKI (SEQ ID NO: 6596), APVKT (SEQ ID NO: 6379):RPVQ-AA17-RKI (SEQ ID NO: 6596), VPQAL (SEQ ID NO: 6410):RPVQ-AA17-RKI (SEQ ID NO: 6596), VSQDL (SEQ ID NO: 6429):RPVQ-AA17-RKI (SEQ ID NO: 6596), VPQDL (SEQ ID NO: 6411):RPVQ-AA17-RKI (SEQ ID NO: 6596), VPTEE (SEQ ID NO: 6420):RPVQ-AA17-RKI (SEQ ID NO: 6596), VPTGQ (SEQ ID NO: 6422):RPVQ-AA17-RKI (SEQ ID NO: 6596) and SRVHH (SEQ ID NO: 6382):RPVQ-AA17-RKI (SEQ ID NO: 6596); and wherein $AA^{17}$ is selected from the group consisting of G, A, V, L, I, P, F, M, W, T and S (in particular is selected from the group consisting of M, I, L, V and T).

In particular, in certain embodiments, the pair PEP12:PEP7 is selected from the group consisting of GIPEPXX (SEQ ID NO: 6440):SAIS-AA17-LYL (SEQ ID NO: 6598), HVTKPTX (SEQ ID NO: 6443):SAIS-AA17-LYL (SEQ ID NO: 6598), YVPKPXX (SEQ ID NO: 6454):SAIS-AA17-LYL (SEQ ID NO: 6598), TVPKPXX (SEQ ID NO: 6453):SAIS-AA17-LYL (SEQ ID NO: 6598), AVPKAXX (SEQ ID NO: 6439):SAIS-AA17-LYL (SEQ ID NO: 6598), KVGKAXX (SEQ ID NO: 6446):SAIS-AA17-LYL (SEQ ID NO: 6598), KASKAXX (SEQ ID NO: 6444):SAIS-AA17-LYL (SEQ ID NO: 6598), GSAGPXX (SEQ ID NO: 6441):SAIS-AA17-LYL (SEQ ID NO: 6598), AAPASXX (SEQ ID NO: 6436):SAIS-AA17-LYL (SEQ ID NO: 6598), STPPTXX (SEQ ID NO: 6452):SAIS-AA17-LYL (SEQ ID NO: 6598), HVPKPXX (SEQ ID NO: 6442):SAIS-AA17-LYL (SEQ ID NO: 6598), RVPSTXX (SEQ ID NO: 6449):SAIS-AA17-LYL (SEQ ID NO: 6598), ASAAPXX (SEQ ID NO: 6437):SAIS-AA17-LYL (SEQ ID NO: 6598), ASASPXX (SEQ ID NO: 6438):SAIS-AA17-LYL (SEQ ID NO: 6598), SSVKXQP (SEQ ID NO: 6451):SAIS-AA17-LYL (SEQ ID NO: 6598), RNVQXRP (SEQ ID NO: 6448):SAIS-AA17-LYL (SEQ ID NO: 6598), KIPKAXX (SEQ ID NO: 6445):SSLS-AA17-LFF (SEQ ID NO: 6605), SIPKAXX (SEQ ID NO: 6450):SSLS-AA17-LFF (SEQ ID NO: 6605), HVTKPTX (SEQ ID NO: 6443):SSLS-AA17-LFF (SEQ ID NO: 6605), YVPKPXX (SEQ ID NO: 6454):SSLS-AA17-LFF (SEQ ID NO: 6605), TVPKPXX (SEQ ID NO: 6453):SSLS-AA17-LFF (SEQ ID NO: 6605), AVPKAXX (SEQ ID NO: 6439):SSLS-AA17-LFF (SEQ ID NO: 6605), KVGKAXX (SEQ ID NO: 6446):SSLS-AA17-LFF (SEQ ID NO: 6605), KASKAXX (SEQ ID NO: 6444):SSLS-AA17-LFF (SEQ ID NO: 6605), GSAGPXX (SEQ ID NO: 6441):SSLS-AA17-LFF (SEQ ID NO: 6605), AAPASXX (SEQ ID NO: 6436):SSLS-AA17-LFF (SEQ ID NO: 6605), STPPTXX (SEQ ID NO: 6452):SSLS-AA17-LFF (SEQ ID NO: 6605), HVPKPXX (SEQ ID NO: 6442):SSLS-AA17-LFF (SEQ ID NO: 6605), RVPSTXX (SEQ ID NO: 6449):SSLS-AA17-LFF (SEQ ID NO: 6605), ASAAPXX (SEQ ID NO: 6437):SSLS-AA17-LFF (SEQ ID NO: 6605), ASASPXX (SEQ ID NO: 6438):SSLS-AA17-LFF (SEQ ID NO: 6605), NDEGLEX (SEQ ID NO: 6447):SSLS-AA17-LFF (SEQ ID NO: 6605), SSVKXQP (SEQ ID NO: 6451):SSLS-AA17-LFF (SEQ ID NO: 6605), RNVQXRP (SEQ ID NO: 6448):SSLS-AA17-LFF (SEQ ID NO: 6605), KIPKAXX (SEQ ID NO: 6445):NAIS-AA17-LYF (SEQ ID NO: 6595), GIPEPXX (SEQ ID NO: 6440):NAIS-AA17-LYF (SEQ ID NO: 6595), SIPKAXX (SEQ ID NO: 6450):NAIS-AA17-LYF (SEQ ID NO: 6595), AVPKAXX (SEQ ID NO: 6439):NAIS-AA17-LYF (SEQ ID NO: 6595), KVGKAXX (SEQ ID NO: 6446):NAIS-AA17-LYF (SEQ ID NO: 6595), KASKAXX (SEQ ID NO: 6444):NAIS-AA17-LYF (SEQ ID NO: 6595), GSAGPXX (SEQ ID NO: 6441):NAIS-AA17-LYF (SEQ ID NO: 6595), AAPASXX (SEQ ID NO: 6436):NAIS-AA17-LYF (SEQ ID NO: 6595), STPPTXX (SEQ ID NO: 6452):NAIS-AA17-LYF (SEQ ID NO: 6595), RVPSTXX (SEQ ID NO: 6449):NAIS-AA17-LYF (SEQ ID NO: 6595), ASAAPXX (SEQ ID NO: 6437):NAIS-AA17-LYF (SEQ ID NO: 6595), ASASPXX (SEQ ID NO: 6438):NAIS-AA17-LYF (SEQ ID NO: 6595), NDEGLEX (SEQ ID NO: 6447):NAIS-AA17-LYF (SEQ ID NO: 6595), SSVKXQP (SEQ ID NO: 6451):NAIS-AA17-LYF (SEQ ID NO: 6595), RNVQXRP (SEQ ID NO: 6448):NAIS-AA17-LYF (SEQ ID NO: 6595), KIPKAXX (SEQ ID NO: 6445):SATS-AA17-LYY (SEQ ID NO: 6599), GIPEPXX (SEQ ID NO: 6440):SATS-AA17-LYY (SEQ ID NO: 6599), SIPKAXX (SEQ ID NO: 6450):SATS-AA17-LYY (SEQ ID NO: 6599), HVTKPTX (SEQ ID NO: 6443):SATS-AA17-LYY (SEQ ID NO: 6599), YVPKPXX (SEQ ID NO: 6454):SATS-AA17-LYY (SEQ ID NO: 6599), TVPKPXX (SEQ ID NO: 6453):SATS-AA17-LYY (SEQ ID NO: 6599), KVGKAXX (SEQ ID NO: 6446):SATS-AA17-LYY (SEQ ID NO: 6599), KASKAXX (SEQ ID NO: 6444):SATS-AA17-LYY (SEQ ID NO: 6599), GSAGPXX (SEQ ID NO: 6441):SATS-AA17-LYY (SEQ ID NO: 6599), AAPASXX (SEQ ID NO: 6436):SATS-AA17-LYY (SEQ ID NO: 6599), STPPTXX (SEQ ID NO: 6452):SATS-AA17-LYY (SEQ ID NO: 6599), HVPKPXX (SEQ ID NO: 6442):SATS-AA17-LYY (SEQ ID NO: 6599), RVPSTXX (SEQ ID NO: 6449):SATS-AA17-LYY (SEQ ID NO: 6599), ASAAPXX (SEQ ID NO: 6437):SATS-AA17-LYY (SEQ ID NO: 6599), ASASPXX (SEQ ID NO: 6438):SATS-AA17-LYY (SEQ ID NO: 6599), NDEGLEX (SEQ ID NO: 6447):SATS-AA17-LYY (SEQ ID NO: 6599), SSVKXQP (SEQ ID NO: 6451):SATS-AA17-LYY (SEQ ID NO: 6599), RNVQXRP (SEQ ID NO: 6448):SATS-AA17-LYY (SEQ ID NO: 6599), KIPKAXX (SEQ ID NO: 6445):SPIS-AA17-LYK (SEQ ID NO: 6604), GIPEPXX (SEQ ID NO: 6440):SPIS-AA17-LYK (SEQ ID NO: 6604), SIPKAXX (SEQ ID NO: 6450):SPIS-AA17-LYK (SEQ ID NO: 6604), HVTKPTX (SEQ ID NO: 6443):SPIS-AA17-LYK (SEQ ID NO: 6604), YVPKPXX (SEQ ID NO: 6454):SPIS-AA17-LYK (SEQ ID NO: 6604), TVPKPXX (SEQ ID NO: 6453):SPIS-AA17-LYK (SEQ ID NO: 6604), AVPKAXX (SEQ ID NO: 6439):SPIS-AA17-LYK (SEQ ID NO: 6604), KASKAXX (SEQ ID NO: 6444):SPIS-AA17-LYK (SEQ ID NO: 6604), GSAGPXX (SEQ ID NO: 6441):SPIS-AA17-LYK (SEQ ID NO: 6604), AAPASXX (SEQ ID NO: 6436):SPIS-AA17-LYK (SEQ ID NO: 6604), STPPTXX (SEQ ID NO: 6452):SPIS-AA17-LYK (SEQ ID NO: 6604), HVPKPXX (SEQ ID NO: 6442):SPIS-AA17-LYK (SEQ ID NO: 6604), RVPSTXX (SEQ ID NO: 6449):SPIS-AA17-LYK (SEQ ID NO: 6604), ASAAPXX (SEQ ID NO: 6437):SPIS-AA17-LYK (SEQ ID NO: 6604), ASASPXX (SEQ ID NO: 6438):SPIS-AA17-LYK (SEQ ID NO: 6604), SSVKXQP (SEQ ID NO: 6451):SPIS-AA17-LYK (SEQ ID NO: 6604), RNVQXRP (SEQ ID NO: 6448):SPIS-AA17-LYK (SEQ ID NO: 6604), KIPKAXX (SEQ ID NO: 6445):EPIS-AA17-LYL (SEQ ID NO: 6591), GIPEPXX (SEQ ID NO: 6440):EPIS-AA17-LYL (SEQ ID NO: 6591), SIPKAXX (SEQ ID NO: 6450):EPIS-AA17-LYL (SEQ ID NO: 6591), HVTKPTX (SEQ ID NO: 6443):EPIS-AA17-LYL (SEQ ID NO: 6591), YVPKPXX (SEQ ID NO: 6454):EPIS-AA17-LYL (SEQ ID NO: 6591), TVPKPXX (SEQ ID NO: 6453):EPIS-AA17-LYL (SEQ ID NO: 6591), AVPKAXX (SEQ ID NO: 6439):EPIS-AA17-LYL (SEQ ID NO: 6591), KVGKAXX (SEQ ID NO: 6446):EPIS-AA17-LYL (SEQ ID NO: 6591), GSAGPXX (SEQ ID NO: 6441):EPIS-AA17-LYL (SEQ ID NO: 6591), AAPASXX (SEQ ID NO: 6436):EPIS-AA17-LYL (SEQ ID NO: 6591), STPPTXX (SEQ ID NO: 6452):EPIS-AA17-LYL (SEQ ID NO: 6591), HVPKPXX (SEQ ID NO: 6442):EPIS-AA17-LYL (SEQ ID NO: 6591), RVPSTXX (SEQ ID NO: 6449):EPIS-AA17-LYL (SEQ ID NO: 6591), ASAAPXX (SEQ ID NO: 6437):EPIS-AA17-LYL (SEQ ID NO: 6591), ASASPXX (SEQ ID NO: 6438):EPIS-AA17-LYL (SEQ ID NO: 6591), SSVKXQP (SEQ ID NO: 6451):EPIS-AA17-LYL (SEQ ID NO: 6591), RNVQXRP (SEQ ID NO: 6448):EPIS-AA17-LYL (SEQ ID NO: 6591), KIPKAXX (SEQ ID NO: 6445):SPIN-AA17-LYF (SEQ ID NO: 6601), GIPEPXX (SEQ ID NO: 6440):SPIN-AA17-LYF (SEQ ID NO: 6601), SIPKAXX (SEQ ID NO: 6450):SPIN-AA17-LYF (SEQ ID NO: 6601), HVTKPTX (SEQ ID NO: 6443):SPIN-AA17-LYF (SEQ ID NO: 6601), YVPKPXX (SEQ ID NO: 6454):SPIN-AA17-LYF (SEQ ID NO: 6601), TVPKPXX (SEQ ID NO: 6453):SPIN-AA17-LYF (SEQ ID NO: 6601), AVPKAXX (SEQ ID NO: 6439):SPIN-AA17-LYF (SEQ ID NO: 6601), KVGKAXX (SEQ ID NO: 6446):SPIN-AA17-LYF (SEQ ID NO: 6601), KASKAXX (SEQ ID NO: 6444):SPIN-AA17-LYF (SEQ ID NO: 6601), AAPASXX (SEQ ID NO: 6436):SPIN-AA17-LYF (SEQ ID NO: 6601), STPPTXX (SEQ ID NO: 6452):SPIN-AA17-LYF (SEQ ID NO: 6601), HVPKPXX (SEQ ID NO: 6442):SPIN-AA17-LYF (SEQ ID NO: 6601), RVPSTXX (SEQ ID NO: 6449):SPIN-AA17-LYF (SEQ ID NO: 6601), ASAAPXX (SEQ ID NO: 6437):SPIN-AA17-LYF (SEQ ID NO: 6601), ASASPXX (SEQ ID NO: 6438):SPIN-AA17-LYF (SEQ ID NO: 6601), NDEGLEX (SEQ ID NO: 6447):SPIN-AA17-LYF (SEQ ID NO: 6601), SSVKXQP (SEQ ID NO: 6451):SPIN-AA17-LYF (SEQ ID NO: 6601), RNVQXRP (SEQ ID NO: 6448):SPIN-AA17-LYF (SEQ ID NO: 6601), KIPKAXX (SEQ ID NO: 6445):SPIS-AA17-LYI (SEQ ID NO: 6603), GIPEPXX (SEQ ID NO: 6440):SPIS-AA17-LYI (SEQ ID NO: 6603), SIPKAXX (SEQ ID NO: 6450):SPIS-AA17-LYI (SEQ ID NO: 6603), HVTKPTX (SEQ ID NO: 6443):SPIS-AA17-LYI (SEQ ID NO: 6603), YVPKPXX (SEQ ID NO: 6454):SPIS-AA17-LYI (SEQ ID NO: 6603), TVPKPXX (SEQ ID NO: 6453):SPIS-AA17-LYI (SEQ ID NO: 6603), AVPKAXX (SEQ ID NO: 6439):SPIS-AA17-LYI (SEQ ID NO: 6603), KVGKAXX (SEQ ID NO: 6446):SPIS-AA17-LYI (SEQ ID NO: 6603), KASKAXX (SEQ ID NO: 6444):SPIS-AA17-LYI (SEQ ID NO: 6603), GSAGPXX (SEQ ID NO: 6441):SPIS-AA17-LYI (SEQ ID NO: 6603), STPPTXX (SEQ ID NO: 6452):SPIS-AA17-LYI (SEQ ID NO: 6603), HVPKPXX (SEQ ID NO: 6442):SPIS-AA17-LYI (SEQ ID NO: 6603), RVPSTXX (SEQ ID NO: 6449):SPIS-AA17-LYI (SEQ ID NO: 6603), ASAAPXX (SEQ ID NO: 6437):SPIS-AA17-LYI (SEQ ID NO: 6603), ASASPXX (SEQ ID NO: 6438):SPIS-AA17-LYI (SEQ ID NO: 6603), NDEGLEX (SEQ ID NO: 6447):SPIS-AA17-LYI (SEQ ID NO: 6603), SSVKXQP (SEQ ID NO: 6451):SPIS-AA17-LYI (SEQ ID NO: 6603), RNVQXRP (SEQ ID NO: 6448):SPIS-AA17-LYI (SEQ ID NO: 6603), KIPKAXX (SEQ ID NO: 6445):SPIS-AA17-LFI (SEQ ID NO: 6602), GIPEPXX (SEQ ID NO: 6440):SPIS-AA17-LFI (SEQ ID NO: 6602), SIPKAXX (SEQ ID NO: 6450):SPIS-AA17-LFI (SEQ ID NO: 6602), HVTKPTX (SEQ ID NO: 6443):SPIS-AA17-LFI (SEQ ID NO: 6602), YVPKPXX (SEQ ID NO: 6454):SPIS-AA17-LFI (SEQ ID NO: 6602), TVPKPXX (SEQ ID NO: 6453):SPIS-AA17-LFI (SEQ ID NO: 6602), AVPKAXX (SEQ ID NO: 6439):SPIS-AA17-LFI (SEQ ID NO: 6602), KVGKAXX (SEQ ID NO: 6446):SPIS-AA17-LFI (SEQ ID NO: 6602), KASKAXX (SEQ ID NO: 6444):SPIS-AA17-LFI (SEQ ID NO: 6602), GSAGPXX (SEQ ID NO: 6441):SPIS-AA17-LFI (SEQ ID NO: 6602), AAPASXX (SEQ ID NO: 6436):SPIS-AA17-LFI (SEQ ID NO: 6602), HVPKPXX (SEQ ID NO: 6442):SPIS-AA17-LFI (SEQ ID NO: 6602), RVPSTXX (SEQ ID NO: 6449):SPIS-AA17-LFI (SEQ ID NO: 6602), ASAAPXX (SEQ ID NO: 6437):SPIS-AA17-LFI (SEQ ID NO: 6602), ASASPXX (SEQ ID NO: 6438):SPIS-AA17-LFI (SEQ ID NO: 6602), SSVKXQP (SEQ ID NO: 6451):SPIS-AA17-LFI (SEQ ID NO: 6602), RNVQXRP (SEQ ID NO: 6448):SPIS-AA17-LFI (SEQ ID NO: 6602), KIPKAXX (SEQ ID NO: 6445):KPLS-AA17-LYV (SEQ ID NO: 6594), GIPEPXX (SEQ ID NO: 6440):KPLS-AA17-LYV (SEQ ID NO: 6594), SIPKAXX (SEQ ID NO: 6450):KPLS-AA17-LYV (SEQ ID NO: 6594), HVTKPTX (SEQ ID NO: 6443):KPLS-AA17-LYV (SEQ ID NO: 6594), YVPKPXX (SEQ ID NO: 6454):KPLS-AA17-LYV (SEQ ID NO: 6594), TVPKPXX (SEQ ID NO: 6453): KPLS-AA17-LYV (SEQ ID NO: 6594), AVPKAXX (SEQ ID NO: 6439):KPLS-AA17-LYV (SEQ ID NO: 6594), KVGKAXX (SEQ ID NO: 6446):KPLS-AA17-LYV (SEQ ID NO: 6594), KASKAXX (SEQ ID NO: 6444):KPLS-AA17-LYV (SEQ ID NO: 6594), GSAGPXX (SEQ ID NO: 6441):KPLS-AA17-LYV (SEQ ID NO: 6594), AAPASXX (SEQ ID NO: 6436):KPLS-AA17-LYV (SEQ ID NO: 6594), STPPTXX (SEQ ID NO: 6452):KPLS-AA17-LYV (SEQ ID NO: 6594), HVPKPXX (SEQ ID NO: 6442): KPLS-AA17-LYV (SEQ ID NO: 6594), ASAAPXX (SEQ ID NO: 6437):KPLS-AA17-LYV (SEQ ID NO: 6594), ASASPXX (SEQ ID NO: 6438):KPLS-AA17-LYV (SEQ ID NO: 6594), NDEGLEX (SEQ ID NO: 6447):KPLS-AA17-LYV (SEQ ID NO: 6594), SSVKXQP (SEQ ID NO: 6451):KPLS-AA17-LYV (SEQ ID NO: 6594), RNVQXRP (SEQ ID NO: 6448):KPLS-AA17-LYV (SEQ ID NO: 6594), KIPKAXX (SEQ ID NO: 6445):EPLP-AA17-VYY (SEQ ID NO: 6592), GIPEPXX (SEQ ID NO: 6440):EPLP-AA17-VYY (SEQ ID NO: 6592), SIPKAXX (SEQ ID NO: 6450):EPLP-AA17-VYY (SEQ ID NO: 6592), HVTKPTX (SEQ ID NO: 6443):EPLP-AA17-VYY (SEQ ID NO: 6592), YVPKPXX (SEQ ID NO: 6454):EPLP-AA17-VYY (SEQ ID NO: 6592), TVPKPXX (SEQ ID NO: 6453): EPLP-AA17-VYY (SEQ ID NO: 6592), AVPKAXX (SEQ ID NO: 6439):EPLP-AA17-VYY (SEQ ID NO: 6592), KVGKAXX (SEQ ID NO: 6446):EPLP-AA17-VYY (SEQ ID NO: 6592), KASKAXX (SEQ ID NO: 6444):EPLP-AA17-VYY (SEQ ID NO: 6592), GSAGPXX (SEQ ID NO: 6441):EPLP-AA17-VYY (SEQ ID NO: 6592), AAPASXX (SEQ ID NO: 6436):EPLP-AA17-VYY (SEQ ID NO: 6592), STPPTXX (SEQ ID NO: 6452):EPLP-AA17-VYY (SEQ ID NO: 6592), HVPKPXX (SEQ ID NO: 6442): EPLP-AA17-VYY (SEQ ID NO: 6592), RVPSTXX (SEQ ID NO: 6449):EPLP-AA17-VYY (SEQ ID NO: 6592), ASASPXX (SEQ ID NO: 6438):EPLP-AA17-VYY (SEQ ID NO: 6592), NDEGLEX (SEQ ID NO: 6447):EPLP-AA17-VYY (SEQ ID NO: 6592), SSVKXQP (SEQ ID NO: 6451):EPLP-AA17-VYY (SEQ ID NO: 6592), RNVQXRP (SEQ ID NO: 6448):EPLP-AA17-VYY (SEQ ID NO: 6592), KIPKAXX (SEQ ID NO: 6445):EPLT-AA17-LYY (SEQ ID NO: 6593), GIPEPXX (SEQ ID NO: 6440):EPLT-AA17-LYY (SEQ ID NO: 6593), SIPKAXX (SEQ ID NO: 6450):EPLT-AA17-LYY (SEQ ID NO: 6593), HVTKPTX (SEQ ID NO: 6443):EPLT-AA17-LYY (SEQ ID NO: 6593), YVPKPXX (SEQ ID NO: 6454):EPLT-AA17-LYY (SEQ ID NO: 6593), TVPKPXX (SEQ ID NO: 6453):EPLT-AA17-LYY (SEQ ID NO: 6593), AVPKAXX (SEQ ID NO: 6439):EPLT-AA17-LYY (SEQ ID NO: 6593), KVGKAXX (SEQ ID NO: 6446):EPLT-AA17-LYY (SEQ ID NO: 6593), KASKAXX (SEQ ID NO: 6444):EPLT-AA17-LYY (SEQ ID NO: 6593), GSAGPXX (SEQ ID NO: 6441):EPLT-AA17-LYY (SEQ ID NO: 6593), AAPASXX (SEQ ID NO: 6436):EPLT-AA17-LYY (SEQ ID NO: 6593), STPPTXX (SEQ ID NO: 6452):EPLT-AA17-LYY (SEQ ID NO: 6593), HVPKPXX (SEQ ID NO: 6442):EPLT-AA17-LYY (SEQ ID NO: 6593), RVPSTXX (SEQ ID NO: 6449):EPLT-AA17-LYY (SEQ ID NO: 6593), ASAAPXX (SEQ ID NO: 6437):EPLT-AA17-LYY (SEQ ID NO: 6593), ASASPXX (SEQ ID NO: 6438):EPLT-AA17-LYY (SEQ ID NO: 6593), NDEGLEX (SEQ ID NO: 6447):EPLT-AA17-LYY (SEQ ID NO: 6593), SSVKXQP (SEQ ID NO: 6451):EPLT-AA17-LYY (SEQ ID NO: 6593), RNVQXRP (SEQ ID NO: 6448):EPLT-AA17-LYY (SEQ ID NO: 6593), NDEGLEX (SEQ ID NO: 6447):SNIT-AA17-QIM (SEQ ID NO: 6600), GIPEPXX (SEQ ID NO: 6440):SNIT-AA17-QIM (SEQ ID NO: 6600), HVTKPTX (SEQ ID NO: 6443):SNIT-AA17-QIM (SEQ ID NO: 6600), YVPKPXX (SEQ ID NO: 6454):

SNIT-AA17-QIM (SEQ ID NO: 6600), TVPKPXX (SEQ ID NO: 6453):SNIT-AA17-QIM (SEQ ID NO: 6600), AVPKAXX (SEQ ID NO: 6439):SNIT-AA17-QIM (SEQ ID NO: 6600), GSAGPXX (SEQ ID NO: 6441):SNIT-AA17-QIM (SEQ ID NO: 6600), AAPASXX (SEQ ID NO: 6436):SNIT-AA17-QIM (SEQ ID NO: 6600), HVPKPXX (SEQ ID NO: 6442):SNIT-AA17-QIM (SEQ ID NO: 6600), RVPSTXX (SEQ ID NO: 6449):SNIT-AA17-QIM (SEQ ID NO: 6600), ASAAPXX (SEQ ID NO: 6437):SNIT-AA17-QIM (SEQ ID NO: 6600), ASASPXX (SEQ ID NO: 6438): SNIT-AA17-QIM (SEQ ID NO: 6600), SSVKXQP (SEQ ID NO: 6451):SNIT-AA17-QIM (SEQ ID NO: 6600), RNVQXRP (SEQ ID NO: 6448):SNIT-AA17-QIM (SEQ ID NO: 6600), RNVQXRP (SEQ ID NO: 6448):RSVK-AA17-AKV (SEQ ID NO: 6597), KIPKAXX (SEQ ID NO: 6445):RSVK-AA17-AKV (SEQ ID NO: 6597), GIPEPXX (SEQ ID NO: 6440):RSVK-AA17-AKV (SEQ ID NO: 6597), SIPKAXX (SEQ ID NO: 6450):RSVK-AA17-AKV (SEQ ID NO: 6597), HVTKPTX (SEQ ID NO: 6443):RSVK-AA17-AKV (SEQ ID NO: 6597), YVPKPXX (SEQ ID NO: 6454):RSVK-AA17-AKV (SEQ ID NO: 6597), TVPKPXX (SEQ ID NO: 6453):RSVK-AA17-AKV (SEQ ID NO: 6597), AVPKAXX (SEQ ID NO: 6439):RSVK-AA17-AKV (SEQ ID NO: 6597), KVGKAXX (SEQ ID NO: 6446):RSVK-AA17-AKV (SEQ ID NO: 6597), KASKAXX (SEQ ID NO: 6444):RSVK-AA17-AKV (SEQ ID NO: 6597), GSAGPXX (SEQ ID NO: 6441):RSVK-AA17-AKV (SEQ ID NO: 6597), AAPASXX (SEQ ID NO: 6436):RSVK-AA17-AKV (SEQ ID NO: 6597), STPPTXX (SEQ ID NO: 6452):RSVK-AA17-AKV (SEQ ID NO: 6597), HVPKPXX (SEQ ID NO: 6442):RSVK-AA17-AKV (SEQ ID NO: 6597), RVPSTXX (SEQ ID NO: 6449):RSVK-AA17-AKV (SEQ ID NO: 6597), ASAAPXX (SEQ ID NO: 6437):RSVK-AA17-AKV (SEQ ID NO: 6597), ASASPXX (SEQ ID NO: 6438):RSVK-AA17-AKV (SEQ ID NO: 6597), NDEGLEX (SEQ ID NO: 6447):RSVK-AA17-AKV (SEQ ID NO: 6597), SSVKXQP (SEQ ID NO: 6451):RPVQ-AA17-RKI (SEQ ID NO: 6596), KIPKAXX (SEQ ID NO: 6445):RPVQ-AA17-RKI (SEQ ID NO: 6596), GIPEPXX (SEQ ID NO: 6440):RPVQ-AA17-RKI (SEQ ID NO: 6596), SIPKAXX (SEQ ID NO: 6450):RPVQ-AA17-RKI (SEQ ID NO: 6596), HVTKPTX (SEQ ID NO: 6443):RPVQ-AA17-RKI (SEQ ID NO: 6596), YVPKPXX (SEQ ID NO: 6454):RPVQ-AA17-RKI (SEQ ID NO: 6596), TVPKPXX (SEQ ID NO: 6453):RPVQ-AA17-RKI (SEQ ID NO: 6596), AVPKAXX (SEQ ID NO: 6439):RPVQ-AA17-RKI (SEQ ID NO: 6596), KVGKAXX (SEQ ID NO: 6446):RPVQ-AA17-RKI (SEQ ID NO: 6596), KASKAXX (SEQ ID NO: 6444):RPVQ-AA17-RKI (SEQ ID NO: 6596), GSAGPXX (SEQ ID NO: 6441):RPVQ-AA17-RKI (SEQ ID NO: 6596), AAPASXX (SEQ ID NO: 6436):RPVQ-AA17-RKI (SEQ ID NO: 6596), STPPTXX (SEQ ID NO: 6452):RPVQ-AA17-RKI (SEQ ID NO: 6596), HVPKPXX (SEQ ID NO: 6442):RPVQ-AA17-RKI (SEQ ID NO: 6596), RVPSTXX (SEQ ID NO: 6449):RPVQ-AA17-RKI (SEQ ID NO: 6596), ASAAPXX (SEQ ID NO: 6437):RPVQ-AA17-RKI (SEQ ID NO: 6596), ASASPXX (SEQ ID NO: 6438):RPVQ-AA17-RKI (SEQ ID NO: 6596) and NDEGLEX (SEQ ID NO: 6447):RPVQ-AA17-RKI (SEQ ID NO: 6596); and wherein AA$^{17}$ is selected from the group consisting of G, A, V, L, I, P, F, M, W, T and S (in particular is selected from the group consisting of M, I, L, V and T).

In particular, in certain embodiments, the pair PEP12: PEP9 is selected from the group consisting of GIPEPXXVPTKM (SEQ ID NO: 6493):SAIS-AA17-LYL (SEQ ID NO: 6598), HVTKPTXVPTKL (SEQ ID NO: 6519):SAIS-AA17-LYL (SEQ ID NO: 6598), YVPKPXXVPTKL (SEQ ID NO: 6589):SAIS-AA17-LYL (SEQ ID NO: 6598), TVPKPXXVPTQL (SEQ ID NO: 6581):SAIS-AA17-LYL (SEQ ID NO: 6598), AVPKAXXVPTKL (SEQ ID NO: 6485):SAIS-AA17-LYL (SEQ ID NO: 6598), KVGKAXXVPTKL (SEQ ID NO: 6543):SAIS-AA17-LYL (SEQ ID NO: 6598), KASKAXXVPTKL (SEQ ID NO: 6527):SAIS-AA17-LYL (SEQ ID NO: 6598), GSAGPXXVPTKM (SEQ ID NO: 6501):SAIS-AA17-LYL (SEQ ID NO: 6598), AAPASXXVPTRL (SEQ ID NO: 6461):SAIS-AA17-LYL (SEQ ID NO: 6598), STPPTXXVPTRL (SEQ ID NO: 6573):SAIS-AA17-LYL (SEQ ID NO: 6598), HVPKPXXVPTKL (SEQ ID NO: 6509):SAIS-AA17-LYL (SEQ ID NO: 6598), RVPSTXXVPTKT (SEQ ID NO: 6555):SAIS-AA17-LYL (SEQ ID NO: 6598), ASAAPXXVPTAL (SEQ ID NO: 6469):SAIS-AA17-LYL (SEQ ID NO: 6598), ASASPXXVPTDL (SEQ ID NO: 6477):SAIS-AA17-LYL (SEQ ID NO: 6598), GIPEPXXVPEKM (SEQ ID NO: 6491):SAIS-AA17-LYL (SEQ ID NO: 6598), HVTKPTXAPTKL (SEQ ID NO: 6511):SAIS-AA17-LYL (SEQ ID NO: 6598), YVPKPXXAPTKL (SEQ ID NO: 6583):SAIS-AA17-LYL (SEQ ID NO: 6598), TVPKPXXAPTQL (SEQ ID NO: 6575):SAIS-AA17-LYL (SEQ ID NO: 6598), AVPKAXXAPTKL (SEQ ID NO: 6479):SAIS-AA17-LYL (SEQ ID NO: 6598), GSAGPXXTPTKM (SEQ ID NO: 6497):SAIS-AA17-LYL (SEQ ID NO: 6598), AAPASXXVPARL (SEQ ID NO: 6458):SAIS-AA17-LYL (SEQ ID NO: 6598), HVPKPXXAPTKL (SEQ ID NO: 6503):SAIS-AA17-LYL (SEQ ID NO: 6598), RVPSTXXAPVKT (SEQ ID NO: 6550):SAIS-AA17-LYL (SEQ ID NO: 6598), ASAAPXXVPQAL (SEQ ID NO: 6468):SAIS-AA17-LYL (SEQ ID NO: 6598), ASASPXXVSQDL (SEQ ID NO: 6478):SAIS-AA17-LYL (SEQ ID NO: 6598), ASASPXXVPQDL (SEQ ID NO: 6476):SAIS-AA17-LYL (SEQ ID NO: 6598), SSVKXQPSRVHH (SEQ ID NO: 6565):SAIS-AA17-LYL (SEQ ID NO: 6598), RNVQXRPTQVQL (SEQ ID NO: 6548):SAIS-AA17-LYL (SEQ ID NO: 6598), KIPKAXXVPEEL (SEQ ID NO: 6533):SSLS-AA17-LFF (SEQ ID NO: 6605), SIPKAXXVPEEL (SEQ ID NO: 6561):SSLS-AA17-LFF (SEQ ID NO: 6605), HVTKPTXVPEKL (SEQ ID NO: 6517):SSLS-AA17-LFF (SEQ ID NO: 6605), YVPKPXXVPEKL (SEQ ID NO: 6587):SSLS-AA17-LFF (SEQ ID NO: 6605), TVPKPXXVPEQL (SEQ ID NO: 6579):SSLS-AA17-LFF (SEQ ID NO: 6605), AVPKAXXVPEKL (SEQ ID NO: 6483):SSLS-AA17-LFF (SEQ ID NO: 6605), KVGKAXXVPEKL (SEQ ID NO: 6541):SSLS-AA17-LFF (SEQ ID NO: 6605), KASKAXXVPEKL (SEQ ID NO: 6525):SSLS-AA17-LFF (SEQ ID NO: 6605), GSAGPXXVPEKM (SEQ ID NO: 6499):SSLS-AA17-LFF (SEQ ID NO: 6605), AAPASXXVPERL (SEQ ID NO: 6459):SSLS-AA17-LFF (SEQ ID NO: 6605), STPPTXXVPERL (SEQ ID NO: 6571):SSLS-AA17-LFF (SEQ ID NO: 6605), HVPKPXXVPEKL (SEQ ID NO: 6507):SSLS-AA17-LFF (SEQ ID NO: 6605), RVPSTXXVPEKT (SEQ ID NO: 6553):SSLS-AA17-LFF (SEQ ID NO: 6605), ASAAPXXVPEAL (SEQ ID NO: 6467):SSLS-AA17-LFF (SEQ ID NO: 6605), ASASPXXVPEDL (SEQ ID NO: 6475):SSLS-AA17-LFF (SEQ ID NO: 6605), KIPKAXXVPTEL (SEQ ID NO: 6535):SSLS-AA17-LFF (SEQ ID NO: 6605), SIPKAXXVPTEL (SEQ ID NO: 6563):SSLS-AA17-LFF (SEQ ID NO: 6605), HVTKPTXAPTKL (SEQ ID NO: 6511):SSLS-AA17-LFF (SEQ ID NO: 6605), YVPKPXXAPTKL (SEQ ID NO: 6583):SSLS-AA17-LFF (SEQ ID NO: 6605),

TVPKPXXAPTQL (SEQ ID NO: 6575):SSLS-AA17-LFF (SEQ ID NO: 6605), AVPKAXXAPTKL (SEQ ID NO: 6479):SSLS-AA17-LFF (SEQ ID NO: 6605), KVGKAXXVPTKL (SEQ ID NO: 6543):SSLS-AA17-LFF (SEQ ID NO: 6605), KASKAXXVPTKL (SEQ ID NO: 6527):SSLS-AA17-LFF (SEQ ID NO: 6605), GSAGPXXTPTKM (SEQ ID NO: 6497):SSLS-AA17-LFF (SEQ ID NO: 6605), AAPASXXVPARL (SEQ ID NO: 6458):SSLS-AA17-LFF (SEQ ID NO: 6605), STPPTXXVPTRL (SEQ ID NO: 6573):SSLS-AA17-LFF (SEQ ID NO: 6605), HVPKPXXAPTKL (SEQ ID NO: 6503):SSLS-AA17-LFF (SEQ ID NO: 6605), RVPSTXXAPVKT (SEQ ID NO: 6550):SSLS-AA17-LFF (SEQ ID NO: 6605), ASAAPXXVPQAL (SEQ ID NO: 6468): SSLS-AA17-LFF (SEQ ID NO: 6605), ASASPXXVSQDL (SEQ ID NO: 6478):SSLS-AA17-LFF (SEQ ID NO: 6605), ASASPXXVPQDL (SEQ ID NO: 6476):SSLS-AA17-LFF (SEQ ID NO: 6605), NDEGLEXVPTEE (SEQ ID NO: 6545):SSLS-AA17-LFF (SEQ ID NO: 6605), NDEGLEXVPTGQ (SEQ ID NO: 6546):SSLS-AA17-LFF (SEQ ID NO: 6605), SSVKXQPSRVHH (SEQ ID NO: 6565): SSLS-AA17-LFF (SEQ ID NO: 6605), RNVQXRPTQVQL (SEQ ID NO: 6548):SSLS-AA17-LFF (SEQ ID NO: 6605), KIPKAXXAPTEL (SEQ ID NO: 6529):NAIS-AA17-LYF (SEQ ID NO: 6595), GIPEPXXAPTKM (SEQ ID NO: 6487):NAIS-AA17-LYF (SEQ ID NO: 6595), SIPKAXXAPTEL (SEQ ID NO: 6557):NAIS-AA17-LYF (SEQ ID NO: 6595), AVPKAXXAPTKL (SEQ ID NO: 6479):NAIS-AA17-LYF (SEQ ID NO: 6595), KVGKAXXAPTKL (SEQ ID NO: 6537):NAIS-AA17-LYF (SEQ ID NO: 6595), KASKAXXAPTKL (SEQ ID NO: 6521):NAIS-AA17-LYF (SEQ ID NO: 6595), GSAGPXXAPTKM (SEQ ID NO: 6495):NAIS-AA17-LYF (SEQ ID NO: 6595), AAPASXXAPTRL (SEQ ID NO: 6455):NAIS-AA17-LYF (SEQ ID NO: 6595), STPPTXXAPTRL (SEQ ID NO: 6567):NAIS-AA17-LYF (SEQ ID NO: 6595), RVPSTXXAPTKT (SEQ ID NO: 6549):NAIS-AA17-LYF (SEQ ID NO: 6595), ASAAPXXAPTAL (SEQ ID NO: 6463):NAIS-AA17-LYF (SEQ ID NO: 6595), ASASPXXAPTDL (SEQ ID NO: 6471):NAIS-AA17-LYF (SEQ ID NO: 6595), KIPKAXXVPTEL (SEQ ID NO: 6535):NAIS-AA17-LYF (SEQ ID NO: 6595), GIPEPXXVPEKM (SEQ ID NO: 6491):NAIS-AA17-LYF (SEQ ID NO: 6595), SIPKAXXVPTEL (SEQ ID NO: 6563):NAIS-AA17-LYF (SEQ ID NO: 6595), KVGKAXXVPTKL (SEQ ID NO: 6543):NAIS-AA17-LYF (SEQ ID NO: 6595), KASKAXXVPTKL (SEQ ID NO: 6527):NAIS-AA17-LYF (SEQ ID NO: 6595), GSAGPXXTPTKM (SEQ ID NO: 6497):NAIS-AA17-LYF (SEQ ID NO: 6595), AAPASXXVPARL (SEQ ID NO: 6458):NAIS-AA17-LYF (SEQ ID NO: 6595), STPPTXXVPTRL (SEQ ID NO: 6573):NAIS-AA17-LYF (SEQ ID NO: 6595), RVPSTXXAPVKT (SEQ ID NO: 6550):NAIS-AA17-LYF (SEQ ID NO: 6595), ASAAPXXVPQAL (SEQ ID NO: 6468): NAIS-AA17-LYF (SEQ ID NO: 6595), ASASPXXVSQDL (SEQ ID NO: 6478):NAIS-AA17-LYF (SEQ ID NO: 6595), ASASPXXVPQDL (SEQ ID NO: 6476):NAIS-AA17-LYF (SEQ ID NO: 6595), NDEGLEXVPTEE (SEQ ID NO: 6545):NAIS-AA17-LYF (SEQ ID NO: 6595), NDEGLEXVPTGQ (SEQ ID NO: 6546):NAIS-AA17-LYF (SEQ ID NO: 6595), SSVKXQPSRVHH (SEQ ID NO: 6565):NAIS-AA17-LYF (SEQ ID NO: 6595), RNVQXRPTQVQL (SEQ ID NO: 6548):NAIS-AA17-LYF (SEQ ID NO: 6595), KIPKAXXAPTEL (SEQ ID NO: 6529):SATS-AA17-LYY (SEQ ID NO: 6599), GIPEPXXAPTKM (SEQ ID NO: 6487):SATS-AA17-LYY (SEQ ID NO: 6599), SIPKAXXAPTEL (SEQ ID NO: 6557):SATS-AA17-LYY (SEQ ID NO: 6599), HVTKPTXAPTKL (SEQ ID NO: 6511):SATS-AA17-LYY (SEQ ID NO: 6599), YVPKPXXAPTKL (SEQ ID NO: 6583):SATS-AA17-LYY (SEQ ID NO: 6599), TVPKPXXAPTQL (SEQ ID NO: 6575):SATS-AA17-LYY (SEQ ID NO: 6599), KVGKAXXAPTKL (SEQ ID NO: 6537):SATS-AA17-LYY (SEQ ID NO: 6599), KASKAXXAPTKL (SEQ ID NO: 6521):SATS-AA17-LYY (SEQ ID NO: 6599), GSAGPXXAPTKM (SEQ ID NO: 6495):SATS-AA17-LYY (SEQ ID NO: 6599), AAPASXXAPTRL (SEQ ID NO: 6455):SATS-AA17-LYY (SEQ ID NO: 6599), STPPTXXAPTRL (SEQ ID NO: 6567):SATS-AA17-LYY (SEQ ID NO: 6599), HVPKPXXAPTKL (SEQ ID NO: 6503):SATS-AA17-LYY (SEQ ID NO: 6599), RVPSTXXAPTKT (SEQ ID NO: 6549):SATS-AA17-LYY (SEQ ID NO: 6599), ASAAPXXAPTAL (SEQ ID NO: 6463):SATS-AA17-LYY (SEQ ID NO: 6599), ASASPXXAPTDL (SEQ ID NO: 6471):SATS-AA17-LYY (SEQ ID NO: 6599), KIPKAXXVPTEL (SEQ ID NO: 6535):SATS-AA17-LYY (SEQ ID NO: 6599), GIPEPXXVPEKM (SEQ ID NO: 6491):SATS-AA17-LYY (SEQ ID NO: 6599), SIPKAXXVPTEL (SEQ ID NO: 6563):SATS-AA17-LYY (SEQ ID NO: 6599), KVGKAXXVPTKL (SEQ ID NO: 6543):SATS-AA17-LYY (SEQ ID NO: 6599), KASKAXXVPTKL (SEQ ID NO: 6527):SATS-AA17-LYY (SEQ ID NO: 6599), GSAGPXXTPTKM (SEQ ID NO: 6497):SATS-AA17-LYY (SEQ ID NO: 6599), AAPASXXVPARL (SEQ ID NO: 6458):SATS-AA17-LYY (SEQ ID NO: 6599), STPPTXXVPTRL (SEQ ID NO: 6573):SATS-AA17-LYY (SEQ ID NO: 6599), RVPSTXXAPVKT (SEQ ID NO: 6550):SATS-AA17-LYY (SEQ ID NO: 6599), ASAAPXXVPQAL (SEQ ID NO: 6468):SATS-AA17-LYY (SEQ ID NO: 6599), ASASPXXVSQDL (SEQ ID NO: 6478):SATS-AA17-LYY (SEQ ID NO: 6599), ASASPXXVPQDL (SEQ ID NO: 6476):SATS-AA17-LYY (SEQ ID NO: 6599), NDEGLEXVPTEE (SEQ ID NO: 6545):SATS-AA17-LYY (SEQ ID NO: 6599), NDEGLEXVPTGQ (SEQ ID NO: 6546): SATS-AA17-LYY (SEQ ID NO: 6599), SSVKXQPSRVHH (SEQ ID NO: 6565):SATS-AA17-LYY (SEQ ID NO: 6599), RNVQXRPTQVQL (SEQ ID NO: 6548):SATS-AA17-LYY (SEQ ID NO: 6599), KIPKAXXVPTEL (SEQ ID NO: 6535):SPIS-AA17-LYK (SEQ ID NO: 6604), GIPEPXXVPTKM (SEQ ID NO: 6493):SPIS-AA17-LYK (SEQ ID NO: 6604), SIPKAXXVPTEL (SEQ ID NO: 6563):SPIS-AA17-LYK (SEQ ID NO: 6604), HVTKPTXVPTKL (SEQ ID NO: 6519):SPIS-AA17-LYK (SEQ ID NO: 6604), YVPKPXXVPTKL (SEQ ID NO: 6589):SPIS-AA17-LYK (SEQ ID NO: 6604), TVPKPXXVPTQL (SEQ ID NO: 6581):SPIS-AA17-LYK (SEQ ID NO: 6604), AVPKAXXVPTKL (SEQ ID NO: 6485):SPIS-AA17-LYK (SEQ ID NO: 6604), KASKAXXVPTKL (SEQ ID NO: 6527):SPIS-AA17-LYK (SEQ ID NO: 6604), GSAGPXXVPTKM (SEQ ID NO: 6501):SPIS-AA17-LYK (SEQ ID NO: 6604), AAPASXXVPTRL (SEQ ID NO: 6461):SPIS-AA17-LYK (SEQ ID NO: 6604), STPPTXXVPTRL (SEQ ID NO: 6573):SPIS-AA17-LYK (SEQ ID NO: 6604), HVPKPXXVPTKL (SEQ ID NO: 6509):SPIS-AA17-LYK (SEQ ID NO: 6604), RVPSTXXVPTKT (SEQ ID NO: 6555):SPIS-AA17-LYK (SEQ ID NO: 6604), ASAAPXXVPTAL (SEQ ID NO: 6469):SPIS-AA17-LYK (SEQ ID NO: 6604), ASASPXXVPTDL (SEQ ID NO: 6477):SPIS-AA17-LYK (SEQ ID NO: 6604), GIPEPXXVPEKM (SEQ ID NO: 6491):SPIS-AA17-LYK (SEQ ID NO:

6604), HVTKPTXAPTKL (SEQ ID NO: 6511):SPIS-AA17-LYK (SEQ ID NO: 6604), YVPKPXXAPTKL (SEQ ID NO: 6583):SPIS-AA17-LYK (SEQ ID NO: 6604), TVPKPXXAPTQL (SEQ ID NO: 6575):SPIS-AA17-LYK (SEQ ID NO: 6604), AVPKAXXAPTKL (SEQ ID NO: 6479):SPIS-AA17-LYK (SEQ ID NO: 6604), GSAGPXXTPTKM (SEQ ID NO: 6497):SPIS-AA17-LYK (SEQ ID NO: 6604), AAPASXXVPARL (SEQ ID NO: 6458):SPIS-AA17-LYK (SEQ ID NO: 6604), HVPKPXXAPTKL (SEQ ID NO: 6503):SPIS-AA17-LYK (SEQ ID NO: 6604), RVPSTXXAPVKT (SEQ ID NO: 6550):SPIS-AA17-LYK (SEQ ID NO: 6604), ASAAPXXVPQAL (SEQ ID NO: 6468):SPIS-AA17-LYK (SEQ ID NO: 6604), ASASPXXVSQDL (SEQ ID NO: 6478):SPIS-AA17-LYK (SEQ ID NO: 6604), ASASPXXVPQDL (SEQ ID NO: 6476):SPIS-AA17-LYK (SEQ ID NO: 6604), SSVKXQPSRVHH (SEQ ID NO: 6565):SPIS-AA17-LYK (SEQ ID NO: 6604), RNVQXRPTQVQL (SEQ ID NO: 6548):SPIS-AA17-LYK (SEQ ID NO: 6604), KIPKAXXVPTEL (SEQ ID NO: 6535):EPIS-AA17-LYL (SEQ ID NO: 6591), GIPEPXXVPTKM (SEQ ID NO: 6493):EPIS-AA17-LYL (SEQ ID NO: 6591), SIPKAXXVPTEL (SEQ ID NO: 6563):EPIS-AA17-LYL (SEQ ID NO: 6591), HVTKPTXVPTKL (SEQ ID NO: 6519):EPIS-AA17-LYL (SEQ ID NO: 6591), YVPKPXXVPTKL (SEQ ID NO: 6589):EPIS-AA17-LYL (SEQ ID NO: 6591), TVPKPXXVPTQL (SEQ ID NO: 6581):EPIS-AA17-LYL (SEQ ID NO: 6591), AVPKAXXVPTKL (SEQ ID NO: 6485):EPIS-AA17-LYL (SEQ ID NO: 6591), KVGKAXXVPTKL (SEQ ID NO: 6543):EPIS-AA17-LYL (SEQ ID NO: 6591), GSAGPXXVPTKM (SEQ ID NO: 6501):EPIS-AA17-LYL (SEQ ID NO: 6591), AAPASXXVPTRL (SEQ ID NO: 6461):EPIS-AA17-LYL (SEQ ID NO: 6591), STPPTXXVPTRL (SEQ ID NO: 6573):EPIS-AA17-LYL (SEQ ID NO: 6591), HVPKPXXVPTKL (SEQ ID NO: 6509):EPIS-AA17-LYL (SEQ ID NO: 6591), RVPSTXXVPTKT (SEQ ID NO: 6555):EPIS-AA17-LYL (SEQ ID NO: 6591), ASAAPXXVPTAL (SEQ ID NO: 6469):EPIS-AA17-LYL (SEQ ID NO: 6591), ASASPXXVPTDL (SEQ ID NO: 6477):EPIS-AA17-LYL (SEQ ID NO: 6591), GIPEPXXVPEKM (SEQ ID NO: 6491):EPIS-AA17-LYL (SEQ ID NO: 6591), HVTKPTXAPTKL (SEQ ID NO: 6511):EPIS-AA17-LYL (SEQ ID NO: 6591), YVPKPXXAPTKL (SEQ ID NO: 6583):EPIS-AA17-LYL (SEQ ID NO: 6591), TVPKPXXAPTQL (SEQ ID NO: 6575):EPIS-AA17-LYL (SEQ ID NO: 6591), AVPKAXXAPTKL (SEQ ID NO: 6479):EPIS-AA17-LYL (SEQ ID NO: 6591), GSAGPXXTPTKM (SEQ ID NO: 6497):EPIS-AA17-LYL (SEQ ID NO: 6591), AAPASXXVPARL (SEQ ID NO: 6458):EPIS-AA17-LYL (SEQ ID NO: 6591), HVPKPXXAPTKL (SEQ ID NO: 6503):EPIS-AA17-LYL (SEQ ID NO: 6591), RVPSTXXAPVKT (SEQ ID NO: 6550):EPIS-AA17-LYL (SEQ ID NO: 6591), ASAAPXXVPQAL (SEQ ID NO: 6468):EPIS-AA17-LYL (SEQ ID NO: 6591), ASASPXXVSQDL (SEQ ID NO: 6478):EPIS-AA17-LYL (SEQ ID NO: 6591), ASASPXXVPQDL (SEQ ID NO: 6476):EPIS-AA17-LYL (SEQ ID NO: 6591), SSVKXQPSRVHH (SEQ ID NO: 6565):EPIS-AA17-LYL (SEQ ID NO: 6591), RNVQXRPTQVQL (SEQ ID NO: 6548):EPIS-AA17-LYL (SEQ ID NO: 6591), KIPKAXXTPTEL (SEQ ID NO: 6531):SPIN-AA17-LYF (SEQ ID NO: 6601), GIPEPXXTPTKM (SEQ ID NO: 6489):SPIN-AA17-LYF (SEQ ID NO: 6601), SIPKAXXTPTEL (SEQ ID NO: 6559):SPIN-AA17-LYF (SEQ ID NO: 6601), HVTKPTXTPTKL (SEQ ID NO: 6514):SPIN-AA17-LYF (SEQ ID NO: 6601), YVPKPXXTPTKL (SEQ ID NO: 6585):SPIN-AA17-LYF (SEQ ID NO: 6601), TVPKPXXTPTQL (SEQ ID NO: 6577):SPIN-AA17-LYF (SEQ ID NO: 6601), AVPKAXXTPTKL (SEQ ID NO: 6481):SPIN-AA17-LYF (SEQ ID NO: 6601), KVGKAXXTPTKL (SEQ ID NO: 6539):SPIN-AA17-LYF (SEQ ID NO: 6601), KASKAXXTPTKL (SEQ ID NO: 6523):SPIN-AA17-LYF (SEQ ID NO: 6601), AAPASXXTPTRL (SEQ ID NO: 6457):SPIN-AA17-LYF (SEQ ID NO: 6601), STPPTXXTPTRL (SEQ ID NO: 6569):SPIN-AA17-LYF (SEQ ID NO: 6601), HVPKPXXTPTKL (SEQ ID NO: 6505):SPIN-AA17-LYF (SEQ ID NO: 6601), RVPSTXXTPTKT (SEQ ID NO: 6551):SPIN-AA17-LYF (SEQ ID NO: 6601), ASAAPXXTPTAL (SEQ ID NO: 6465):SPIN-AA17-LYF (SEQ ID NO: 6601), ASASPXXTPTDL (SEQ ID NO: 6473):SPIN-AA17-LYF (SEQ ID NO: 6601), KIPKAXXVPTEL (SEQ ID NO: 6535):SPIN-AA17-LYF (SEQ ID NO: 6601), GIPEPXXVPEKM (SEQ ID NO: 6491):SPIN-AA17-LYF (SEQ ID NO: 6601), SIPKAXXVPTEL (SEQ ID NO: 6563):SPIN-AA17-LYF (SEQ ID NO: 6601), HVTKPTXAPTKL (SEQ ID NO: 6511):SPIN-AA17-LYF (SEQ ID NO: 6601), YVPKPXXAPTKL (SEQ ID NO: 6583):SPIN-AA17-LYF (SEQ ID NO: 6601), TVPKPXXAPTQL (SEQ ID NO: 6575):SPIN-AA17-LYF (SEQ ID NO: 6601), AVPKAXXAPTKL (SEQ ID NO: 6479):SPIN-AA17-LYF (SEQ ID NO: 6601), KVGKAXXVPTKL (SEQ ID NO: 6543):SPIN-AA17-LYF (SEQ ID NO: 6601), KASKAXXVPTKL (SEQ ID NO: 6527):SPIN-AA17-LYF (SEQ ID NO: 6601), AAPASXXVPARL (SEQ ID NO: 6458):SPIN-AA17-LYF (SEQ ID NO: 6601), STPPTXXVPTRL (SEQ ID NO: 6573):SPIN-AA17-LYF (SEQ ID NO: 6601), HVPKPXXAPTKL (SEQ ID NO: 6503):SPIN-AA17-LYF (SEQ ID NO: 6601), RVPSTXXAPVKT (SEQ ID NO: 6550):SPIN-AA17-LYF (SEQ ID NO: 6601), ASAAPXXVPQAL (SEQ ID NO: 6468):SPIN-AA17-LYF (SEQ ID NO: 6601), ASASPXXVSQDL (SEQ ID NO: 6478):SPIN-AA17-LYF (SEQ ID NO: 6601), ASASPXXVPQDL (SEQ ID NO: 6476):SPIN-AA17-LYF (SEQ ID NO: 6601), NDEGLEXVPTEE (SEQ ID NO: 6545):SPIN-AA17-LYF (SEQ ID NO: 6601), NDEGLEXVPTGQ (SEQ ID NO: 6546):SPIN-AA17-LYF (SEQ ID NO: 6601), SSVKXQPSRVHH (SEQ ID NO: 6565):SPIN-AA17-LYF (SEQ ID NO: 6601), RNVQXRPTQVQL (SEQ ID NO: 6548):SPIN-AA17-LYF (SEQ ID NO: 6601), KIPKAXXVPAEL (SEQ ID NO: 6532):SPIS-AA17-LYI (SEQ ID NO: 6603), GIPEPXXVPAKM (SEQ ID NO: 6490):SPIS-AA17-LYI (SEQ ID NO: 6603), SIPKAXXVPAEL (SEQ ID NO: 6560):SPIS-AA17-LYI (SEQ ID NO: 6603), HVTKPTXVPAKL (SEQ ID NO: 6516):SPIS-AA17-LYI (SEQ ID NO: 6603), YVPKPXXVPAKL (SEQ ID NO: 6586):SPIS-AA17-LYI (SEQ ID NO: 6603), TVPKPXXVPAQL (SEQ ID NO: 6578):SPIS-AA17-LYI (SEQ ID NO: 6603), AVPKAXXVPAKL (SEQ ID NO: 6482):SPIS-AA17-LYI (SEQ ID NO: 6603), KVGKAXXVPAKL (SEQ ID NO: 6540):SPIS-AA17-LYI (SEQ ID NO: 6603), KASKAXXVPAKL (SEQ ID NO: 6524):SPIS-AA17-LYI (SEQ ID NO: 6603), GSAGPXXVPAKM (SEQ ID NO: 6498):SPIS-AA17-LYI (SEQ ID NO: 6603), STPPTXXVPARL (SEQ ID NO: 6570):SPIS-AA17-LYI (SEQ ID NO: 6603), HVPKPXXVPAKL (SEQ ID NO: 6506):SPIS-AA17-LYI (SEQ ID NO: 6603), RVPSTXXVPAKT (SEQ ID NO: 6552):SPIS-AA17-LYI (SEQ ID NO: 6603), ASAAPXXVPAAL (SEQ ID NO: 6466):SPIS-AA17-LYI (SEQ ID NO: 6603), ASASPXXVPADL (SEQ ID NO: 6474):SPIS-AA17-LYI (SEQ ID NO: 6603), KIPKAXXVPTEL (SEQ ID NO: 6535):SPIS-AA17-LYI (SEQ ID NO: 6603), GIPEPXXVPEKM (SEQ ID NO: 6491):SPIS-AA17-LYI (SEQ ID NO: 6603), SIPKAXXVPTEL (SEQ ID NO: 6563):SPIS-AA17-LYI (SEQ ID NO: 6603), HVTKPTXAPTKL (SEQ ID NO: 6511):SPIS-AA17-LYI (SEQ ID NO: 6603), YVPKPXXAPTKL (SEQ ID NO: 6583):SPIS-AA17-LYI (SEQ ID NO: 6603), TVPKPXXAPTQL (SEQ ID NO: 6575):SPIS-AA17-LYI (SEQ ID NO: 6603), AVPKAXXAPTKL (SEQ ID NO: 6479):SPIS-AA17-LYI (SEQ ID NO: 6603), KVGKAXXVPTKL (SEQ ID NO: 6543):SPIS-AA17-LYI (SEQ ID NO: 6603), KASKAXXVPTKL (SEQ ID NO: 6527):SPIS-AA17-LYI (SEQ ID NO: 6603), GSAGPXXTPTKM (SEQ ID NO: 6497):SPIS-AA17-LYI (SEQ ID NO: 6603), STPPTXXVPTRL (SEQ ID NO: 6573):SPIS-AA17-LYI (SEQ ID NO: 6603), HVPKPXXAPTKL (SEQ ID NO: 6503):SPIS-AA17-LYI (SEQ ID NO: 6603), RVPSTXXAPVKT (SEQ ID NO: 6550):SPIS-AA17-LYI (SEQ ID NO: 6603), ASAAPXXVPQAL (SEQ ID NO: 6468):SPIS-AA17-LYI (SEQ ID NO: 6603), ASASPXXVSQDL (SEQ ID NO: 6478):SPIS-AA17-LYI (SEQ ID NO: 6603), ASASPXXVPQDL (SEQ ID NO: 6476):SPIS-AA17-LYI (SEQ ID NO: 6603), NDEGLEXVPTEE (SEQ ID NO: 6545):SPIS-AA17-LYI (SEQ ID NO: 6603), NDEGLEXVPTGQ (SEQ ID NO: 6546):SPIS-AA17-LYI (SEQ ID NO: 6603), SSVKXQPSRVHH (SEQ ID NO: 6565):SPIS-AA17-LYI (SEQ ID NO: 6603), RNVQXRPTQVQL (SEQ ID NO: 6548):SPIS-AA17-LYI (SEQ ID NO: 6603), KIPKAXXVPTEL (SEQ ID NO: 6535):SPIS-AA17-LFI (SEQ ID NO: 6602), GIPEPXXVPTKM (SEQ ID NO: 6493):SPIS-AA17-LFI (SEQ ID NO: 6602), SIPKAXXVPTEL (SEQ ID NO: 6563):SPIS-AA17-LFI (SEQ ID NO: 6602), HVTKPTXVPTKL (SEQ ID NO: 6519):SPIS-AA17-LFI (SEQ ID NO: 6602), YVPKPXXVPTKL (SEQ ID NO: 6589):SPIS-AA17-LFI (SEQ ID NO: 6602), TVPKPXXVPTQL (SEQ ID NO: 6581):SPIS-AA17-LFI (SEQ ID NO: 6602), AVPKAXXVPTKL (SEQ ID NO: 6485):SPIS-AA17-LFI (SEQ ID NO: 6602), KVGKAXXVPTKL (SEQ ID NO: 6543):SPIS-AA17-LFI (SEQ ID NO: 6602), KASKAXXVPTKL (SEQ ID NO: 6527):SPIS-AA17-LFI (SEQ ID NO: 6602), GSAGPXXVPTKM (SEQ ID NO: 6501):SPIS-AA17-LFI (SEQ ID NO: 6602), AAPASXXVPTRL (SEQ ID NO: 6461):SPIS-AA17-LFI (SEQ ID NO: 6602), HVPKPXXVPTKL (SEQ ID NO: 6509):SPIS-AA17-LFI (SEQ ID NO: 6602), RVPSTXXVPTKT (SEQ ID NO: 6555):SPIS-AA17-LFI (SEQ ID NO: 6602), ASAAPXXVPTAL (SEQ ID NO: 6469):SPIS-AA17-LFI (SEQ ID NO: 6602), ASASPXXVPTDL (SEQ ID NO: 6477):SPIS-AA17-LFI (SEQ ID NO: 6602), GIPEPXXVPEKM (SEQ ID NO: 6491):SPIS-AA17-LFI (SEQ ID NO: 6602), HVTKPTXAPTKL (SEQ ID NO: 6511):SPIS-AA17-LFI (SEQ ID NO: 6602), YVPKPXXAPTKL (SEQ ID NO: 6583):SPIS-AA17-LFI (SEQ ID NO: 6602), TVPKPXXAPTQL (SEQ ID NO: 6575):SPIS-AA17-LFI (SEQ ID NO: 6602), AVPKAXXAPTKL (SEQ ID NO: 6479):SPIS-AA17-LFI (SEQ ID NO: 6602), GSAGPXXTPTKM (SEQ ID NO: 6497):SPIS-AA17-LFI (SEQ ID NO: 6602), AAPASXXVPARL (SEQ ID NO: 6458):SPIS-AA17-LFI (SEQ ID NO: 6602), HVPKPXXAPTKL (SEQ ID NO: 6503):SPIS-AA17-LFI (SEQ ID NO: 6602), RVPSTXXAPVKT (SEQ ID NO: 6550):SPIS-AA17-LFI (SEQ ID NO: 6602), ASAAPXXVPQAL (SEQ ID NO: 6468):SPIS-AA17-LFI (SEQ ID NO: 6602), ASASPXXVSQDL (SEQ ID NO: 6478):SPIS-AA17-LFI (SEQ ID NO: 6602), ASASPXXVPQDL (SEQ ID NO: 6476):SPIS-AA17-LFI (SEQ ID NO: 6602), SSVKXQPSRVHH (SEQ ID NO: 6565):SPIS-AA17-LFI (SEQ ID NO: 6602), RNVQXRPTQVQL (SEQ ID NO: 6548):SPIS-AA17-LFI (SEQ ID NO: 6602), KIPKAXXAPVEL (SEQ ID NO: 6530):KPLS-AA17-LYV (SEQ ID NO: 6594), GIPEPXXAPVKM (SEQ ID NO: 6488):KPLS-AA17-LYV (SEQ ID NO: 6594), SIPKAXXAPVEL (SEQ ID NO: 6558):KPLS-AA17-LYV (SEQ ID NO: 6594), HVTKPTXAPVKL (SEQ ID NO: 6512):KPLS-AA17-LYV (SEQ ID NO: 6594), YVPKPXXAPVKL (SEQ ID NO: 6584):KPLS-AA17-LYV (SEQ ID NO: 6594), TVPKPXXAPVQL (SEQ ID NO: 6576):KPLS-AA17-LYV (SEQ ID NO: 6594), AVPKAXXAPVKL (SEQ ID NO: 6480):KPLS-AA17-LYV (SEQ ID NO: 6594), KVGKAXXAPVKL (SEQ ID NO: 6538):KPLS-AA17-LYV (SEQ ID NO: 6594), KASKAXXAPVKL (SEQ ID NO: 6522):KPLS-AA17-LYV (SEQ ID NO: 6594), GSAGPXXAPVKM (SEQ ID NO: 6496):KPLS-AA17-LYV (SEQ ID NO: 6594), AAPASXXAPVRL (SEQ ID NO: 6456):KPLS-AA17-LYV (SEQ ID NO: 6594), STPPTXXAPVRL (SEQ ID NO: 6568):KPLS-AA17-LYV (SEQ ID NO: 6594), HVPKPXXAPVKL (SEQ ID NO: 6504):KPLS-AA17-LYV (SEQ ID NO: 6594), ASAAPXXAPVAL (SEQ ID NO: 6464):KPLS-AA17-LYV (SEQ ID NO: 6594), ASASPXXAPVDL (SEQ ID NO: 6472):KPLS-AA17-LYV (SEQ ID NO: 6594), KIPKAXXVPTEL (SEQ ID NO: 6535):KPLS-AA17-LYV (SEQ ID NO: 6594), GIPEPXXVPEKM (SEQ ID NO: 6491):KPLS-AA17-LYV (SEQ ID NO: 6594), SIPKAXXVPTEL (SEQ ID NO: 6563):KPLS-AA17-LYV (SEQ ID NO: 6594), HVTKPTXAPTKL (SEQ ID NO: 6511):KPLS-AA17-LYV (SEQ ID NO: 6594), YVPKPXXAPTKL (SEQ ID NO: 6583):KPLS-AA17-LYV (SEQ ID NO: 6594), TVPKPXXAPTQL (SEQ ID NO: 6575):KPLS-AA17-LYV (SEQ ID NO: 6594), AVPKAXXAPTKL (SEQ ID NO: 6479):KPLS-AA17-LYV (SEQ ID NO: 6594), KVGKAXXVPTKL (SEQ ID NO: 6543):KPLS-AA17-LYV (SEQ ID NO: 6594), KASKAXXVPTKL (SEQ ID NO: 6527):KPLS-AA17-LYV (SEQ ID NO: 6594), GSAGPXXTPTKM (SEQ ID NO: 6497):KPLS-AA17-LYV (SEQ ID NO: 6594), AAPASXXVPARL (SEQ ID NO: 6458):KPLS-AA17-LYV (SEQ ID NO: 6594), STPPTXXVPTRL (SEQ ID NO: 6573):KPLS-AA17-LYV (SEQ ID NO: 6594), HVPKPXXAPTKL (SEQ ID NO: 6503):KPLS-AA17-LYV (SEQ ID NO: 6594), ASAAPXXVPQAL (SEQ ID NO: 6468):KPLS-AA17-LYV (SEQ ID NO: 6594), ASASPXXVSQDL (SEQ ID NO: 6478):KPLS-AA17-LYV (SEQ ID NO: 6594), ASASPXXVPQDL (SEQ ID NO: 6476):KPLS-AA17-LYV (SEQ ID NO: 6594), NDEGLEXVPTEE (SEQ ID NO: 6545):KPLS-AA17-LYV (SEQ ID NO: 6594), NDEGLEXVPTGQ (SEQ ID NO: 6546):KPLS-AA17-LYV (SEQ ID NO: 6594), SSVKXQPSRVHH (SEQ ID NO: 6565):KPLS-AA17-LYV (SEQ ID NO: 6594), RNVQXRPTQVQL (SEQ ID NO: 6548):KPLS-AA17-LYV (SEQ ID NO: 6594), KIPKAXXVPQEL (SEQ ID NO: 6534):EPLP-AA17-VYY (SEQ ID NO: 6592), GIPEPXXVPQKM (SEQ ID NO: 6492):EPLP-AA17-VYY (SEQ ID NO: 6592), SIPKAXXVPQEL (SEQ ID NO: 6562):EPLP-AA17-VYY (SEQ ID NO: 6592), HVTKPTXVPQKL (SEQ ID NO: 6518):EPLP-AA17-VYY (SEQ ID NO: 6592), YVPKPXXVPQKL (SEQ ID NO: 6588):EPLP-AA17-VYY (SEQ ID NO: 6592), TVPKPXXVPQQL (SEQ ID

NO: 6580):EPLP-AA17-VYY (SEQ ID NO: 6592), AVPKAXXVPQKL (SEQ ID NO: 6484):EPLP-AA17-VYY (SEQ ID NO: 6592), KVGKAXXVPQKL (SEQ ID NO: 6542):EPLP-AA17-VYY (SEQ ID NO: 6592), KASKAXXVPQKL (SEQ ID NO: 6526):EPLP-AA17-VYY (SEQ ID NO: 6592), GSAGPXXVPQKM (SEQ ID NO: 6500):EPLP-AA17-VYY (SEQ ID NO: 6592), AAPASXXVPQRL (SEQ ID NO: 6460):EPLP-AA17-VYY (SEQ ID NO: 6592), STPPTXXVPQRL (SEQ ID NO: 6572):EPLP-AA17-VYY (SEQ ID NO: 6592), HVPKPXXVPQKL (SEQ ID NO: 6508):EPLP-AA17-VYY (SEQ ID NO: 6592), RVPSTXXVPQKT (SEQ ID NO: 6554):EPLP-AA17-VYY (SEQ ID NO: 6592), ASASPXXVPQDL (SEQ ID NO: 6476):EPLP-AA17-VYY (SEQ ID NO: 6592), KIPKAXXVPTEL (SEQ ID NO: 6535):EPLP-AA17-VYY (SEQ ID NO: 6592), GIPEPXXVPEKM (SEQ ID NO: 6491):EPLP-AA17-VYY (SEQ ID NO: 6592), SIPKAXXVPTEL (SEQ ID NO: 6563):EPLP-AA17-VYY (SEQ ID NO: 6592), HVTKPTXAPTKL (SEQ ID NO: 6511):EPLP-AA17-VYY (SEQ ID NO: 6592), YVPKPXXAPTKL (SEQ ID NO: 6583):EPLP-AA17-VYY (SEQ ID NO: 6592), TVPKPXXAPTQL (SEQ ID NO: 6575):EPLP-AA17-VYY (SEQ ID NO: 6592), AVPKAXXAPTKL (SEQ ID NO: 6479):EPLP-AA17-VYY (SEQ ID NO: 6592), KVGKAXXVPTKL (SEQ ID NO: 6543):EPLP-AA17-VYY (SEQ ID NO: 6592), KASKAXXVPTKL (SEQ ID NO: 6527):EPLP-AA17-VYY (SEQ ID NO: 6592), GSAGPXXTPTKM (SEQ ID NO: 6497):EPLP-AA17-VYY (SEQ ID NO: 6592), AAPASXXVPARL (SEQ ID NO: 6458):EPLP-AA17-VYY (SEQ ID NO: 6592), STPPTXXVPTRL (SEQ ID NO: 6573):EPLP-AA17-VYY (SEQ ID NO: 6592), HVPKPXXAPTKL (SEQ ID NO: 6503):EPLP-AA17-VYY (SEQ ID NO: 6592), RVPSTXXAPVKT (SEQ ID NO: 6550):EPLP-AA17-VYY (SEQ ID NO: 6592), ASASPXXVSQDL (SEQ ID NO: 6478):EPLP-AA17-VYY (SEQ ID NO: 6592), NDEGLEXVPTEE (SEQ ID NO: 6545):EPLP-AA17-VYY (SEQ ID NO: 6592), NDEGLEXVPTGQ (SEQ ID NO: 6546):EPLP-AA17-VYY (SEQ ID NO: 6592), SSVKXQPSRVHH (SEQ ID NO: 6565):EPLP-AA17-VYY (SEQ ID NO: 6592), RNVQXRPTQVQL (SEQ ID NO: 6548):EPLP-AA17-VYY (SEQ ID NO: 6592), KIPKAXXVSQEL (SEQ ID NO: 6536):EPLT-AA17-LYY (SEQ ID NO: 6593), GIPEPXXVSQKM (SEQ ID NO: 6494):EPLT-AA17-LYY (SEQ ID NO: 6593), SIPKAXXVSQEL (SEQ ID NO: 6564):EPLT-AA17-LYY (SEQ ID NO: 6593), HVTKPTXVSQKL (SEQ ID NO: 6520):EPLT-AA17-LYY (SEQ ID NO: 6593), YVPKPXXVSQKL (SEQ ID NO: 6590):EPLT-AA17-LYY (SEQ ID NO: 6593), TVPKPXXVSQQL (SEQ ID NO: 6582):EPLT-AA17-LYY (SEQ ID NO: 6593), AVPKAXXVSQKL (SEQ ID NO: 6486):EPLT-AA17-LYY (SEQ ID NO: 6593), KVGKAXXVSQKL (SEQ ID NO: 6544):EPLT-AA17-LYY (SEQ ID NO: 6593), KASKAXXVSQKL (SEQ ID NO: 6528):EPLT-AA17-LYY (SEQ ID NO: 6593), GSAGPXXVSQKM (SEQ ID NO: 6502):EPLT-AA17-LYY (SEQ ID NO: 6593), AAPASXXVSQRL (SEQ ID NO: 6462):EPLT-AA17-LYY (SEQ ID NO: 6593), STPPTXXVSQRL (SEQ ID NO: 6574):EPLT-AA17-LYY (SEQ ID NO: 6593), HVPKPXXVSQKL (SEQ ID NO: 6510):EPLT-AA17-LYY (SEQ ID NO: 6593), RVPSTXXVSQKT (SEQ ID NO: 6556):EPLT-AA17-LYY (SEQ ID NO: 6593), ASAAPXXVSQAL (SEQ ID NO: 6470):EPLT-AA17-LYY (SEQ ID NO: 6593), ASASPXXVSQDL (SEQ ID NO: 6478):EPLT-AA17-LYY (SEQ ID NO: 6593), KIPKAXXVPTEL (SEQ ID NO: 6535):EPLT-AA17-LYY (SEQ ID NO: 6593), GIPEPXXVPEKM (SEQ ID NO: 6491):EPLT-AA17-LYY (SEQ ID NO: 6593), SIPKAXXVPTEL (SEQ ID NO: 6563):EPLT-AA17-LYY (SEQ ID NO: 6593), HVTKPTXAPTKL (SEQ ID NO: 6511):EPLT-AA17-LYY (SEQ ID NO: 6593), YVPKPXXAPTKL (SEQ ID NO: 6583):EPLT-AA17-LYY (SEQ ID NO: 6593), TVPKPXXAPTQL (SEQ ID NO: 6575):EPLT-AA17-LYY (SEQ ID NO: 6593), AVPKAXXAPTKL (SEQ ID NO: 6479):EPLT-AA17-LYY (SEQ ID NO: 6593), KVGKAXXVPTKL (SEQ ID NO: 6543):EPLT-AA17-LYY (SEQ ID NO: 6593), KASKAXXVPTKL (SEQ ID NO: 6527):EPLT-AA17-LYY (SEQ ID NO: 6593), GSAGPXXTPTKM (SEQ ID NO: 6497):EPLT-AA17-LYY (SEQ ID NO: 6593), AAPASXXVPARL (SEQ ID NO: 6458):EPLT-AA17-LYY (SEQ ID NO: 6593), STPPTXXVPTRL (SEQ ID NO: 6573):EPLT-AA17-LYY (SEQ ID NO: 6593), HVPKPXXAPTKL (SEQ ID NO: 6503):EPLT-AA17-LYY (SEQ ID NO: 6593), RVPSTXXAPVKT (SEQ ID NO: 6550):EPLT-AA17-LYY (SEQ ID NO: 6593), ASAAPXXVPQAL (SEQ ID NO: 6468):EPLT-AA17-LYY (SEQ ID NO: 6593), NDEGLEXVPTEE (SEQ ID NO: 6545):EPLT-AA17-LYY (SEQ ID NO: 6593), NDEGLEXVPTGQ (SEQ ID NO: 6546):EPLT-AA17-LYY (SEQ ID NO: 6593), SSVKXQPSRVHH (SEQ ID NO: 6565):EPLT-AA17-LYY (SEQ ID NO: 6593), RNVQXRPTQVQL (SEQ ID NO: 6548):EPLT-AA17-LYY (SEQ ID NO: 6593), KIPKAXXVPQEL (SEQ ID NO: 6534):EPLT-AA17-LYY (SEQ ID NO: 6593), GIPEPXXVPQKM (SEQ ID NO: 6492):EPLT-AA17-LYY (SEQ ID NO: 6593), SIPKAXXVPQEL (SEQ ID NO: 6562):EPLT-AA17-LYY (SEQ ID NO: 6593), HVTKPTXVPQKL (SEQ ID NO: 6518):EPLT-AA17-LYY (SEQ ID NO: 6593), YVPKPXXVPQKL (SEQ ID NO: 6588):EPLT-AA17-LYY (SEQ ID NO: 6593), TVPKPXXVPQQL (SEQ ID NO: 6580):EPLT-AA17-LYY (SEQ ID NO: 6593), AVPKAXXVPQKL (SEQ ID NO: 6484):EPLT-AA17-LYY (SEQ ID NO: 6593), KVGKAXXVPQKL (SEQ ID NO: 6542):EPLT-AA17-LYY (SEQ ID NO: 6593), KASKAXXVPQKL (SEQ ID NO: 6526):EPLT-AA17-LYY (SEQ ID NO: 6593), GSAGPXXVPQKM (SEQ ID NO: 6500):EPLT-AA17-LYY (SEQ ID NO: 6593), AAPASXXVPQRL (SEQ ID NO: 6460):EPLT-AA17-LYY (SEQ ID NO: 6593), STPPTXXVPQRL (SEQ ID NO: 6572):EPLT-AA17-LYY (SEQ ID NO: 6593), HVPKPXXVPQKL (SEQ ID NO: 6508):EPLT-AA17-LYY (SEQ ID NO: 6593), RVPSTXXVPQKT (SEQ ID NO: 6554):EPLT-AA17-LYY (SEQ ID NO: 6593), ASASPXXVPQDL (SEQ ID NO: 6476):EPLT-AA17-LYY (SEQ ID NO: 6593), NDEGLEXVPTGQ (SEQ ID NO: 6546):SNIT-AA17-QIM (SEQ ID NO: 6600), GIPEPXXVPEKM (SEQ ID NO: 6491):SNIT-AA17-QIM (SEQ ID NO: 6600), HVTKPTXAPTKL (SEQ ID NO: 6511):SNIT-AA17-QIM (SEQ ID NO: 6600), YVPKPXXAPTKL (SEQ ID NO: 6583):SNIT-AA17-QIM (SEQ ID NO: 6600), TVPKPXXAPTQL (SEQ ID NO: 6575):SNIT-AA17-QIM (SEQ ID NO: 6600), AVPKAXXAPTKL (SEQ ID NO: 6479):SNIT-AA17-QIM (SEQ ID NO: 6600), GSAGPXXTPTKM (SEQ ID NO: 6497):SNIT-AA17-QIM (SEQ ID NO: 6600), AAPASXXVPARL (SEQ ID NO: 6458):SNIT-AA17-QIM (SEQ ID NO: 6600), HVPKPXXAPTKL (SEQ ID NO: 6503):SNIT-AA17-QIM (SEQ ID NO: 6600), RVPSTXXAPVKT (SEQ ID NO: 6550):SNIT-AA17-QIM (SEQ ID NO: 6600), ASAAPXXVPQAL (SEQ ID NO: 6468):SNIT-AA17-QIM (SEQ ID NO: 6600), ASASPXXVSQDL (SEQ ID NO: 6478):SNIT-AA17-QIM (SEQ ID NO: 6600),

ASASPXXVPQDL (SEQ ID NO: 6476):SNIT-AA17-QIM (SEQ ID NO: 6600), SSVKXQPSRVHH (SEQ ID NO: 6565):SNIT-AA17-QIM (SEQ ID NO: 6600), RNVQXRPTQVQL (SEQ ID NO: 6548):SNIT-AA17-QIM (SEQ ID NO: 6600), RNVQXRPSRVQL (SEQ ID NO: 6547):RSVK-AA17-AKV (SEQ ID NO: 6597), KIPKAXXVPTEL (SEQ ID NO: 6535):RSVK-AA17-AKV (SEQ ID NO: 6597), GIPEPXXVPEKM (SEQ ID NO: 6491):RSVK-AA17-AKV (SEQ ID NO: 6597), SIPKAXXVPTEL (SEQ ID NO: 6563):RSVK-AA17-AKV (SEQ ID NO: 6597), HVTKPTXAPTKL (SEQ ID NO: 6511):RSVK-AA17-AKV (SEQ ID NO: 6597), YVPKPXXAPTKL (SEQ ID NO: 6583):RSVK-AA17-AKV (SEQ ID NO: 6597), TVPKPXXAPTQL (SEQ ID NO: 6575):RSVK-AA17-AKV (SEQ ID NO: 6597), AVPKAXXAPTKL (SEQ ID NO: 6479):RSVK-AA17-AKV (SEQ ID NO: 6597), KVGKAXXVPTKL (SEQ ID NO: 6543):RSVK-AA17-AKV (SEQ ID NO: 6597), KASKAXXVPTKL (SEQ ID NO: 6527):RSVK-AA17-AKV (SEQ ID NO: 6597), GSAGPXXTPTKM (SEQ ID NO: 6497):RSVK-AA17-AKV (SEQ ID NO: 6597), AAPASXXVPARL (SEQ ID NO: 6458):RSVK-AA17-AKV (SEQ ID NO: 6597), STPPTXXVPTRL (SEQ ID NO: 6573):RSVK-AA17-AKV (SEQ ID NO: 6597), HVPKPXXAPTKL (SEQ ID NO: 6503):RSVK-AA17-AKV (SEQ ID NO: 6597), RVPSTXXAPVKT (SEQ ID NO: 6550):RSVK-AA17-AKV (SEQ ID NO: 6597), ASAAPXXVPQAL (SEQ ID NO: 6468):RSVK-AA17-AKV (SEQ ID NO: 6597), ASASPXXVSQDL (SEQ ID NO: 6478):RSVK-AA17-AKV (SEQ ID NO: 6597), ASASPXXVPQDL (SEQ ID NO: 6476):RSVK-AA17-AKV (SEQ ID NO: 6597), NDEGLEXVPTEE (SEQ ID NO: 6545):RSVK-AA17-AKV (SEQ ID NO: 6597), NDEGLEXVPTGQ (SEQ ID NO: 6546):RSVK-AA17-AKV (SEQ ID NO: 6597), RNVQXRPTQVQL (SEQ ID NO: 6548):RSVK-AA17-AKV (SEQ ID NO: 6597), SSVKXQPTQVHH (SEQ ID NO: 6566):RPVQ-AA17-RKI (SEQ ID NO: 6596), KIPKAXXVPTEL (SEQ ID NO: 6535):RPVQ-AA17-RKI (SEQ ID NO: 6596), GIPEPXXVPEKM (SEQ ID NO: 6491):RPVQ-AA17-RKI (SEQ ID NO: 6596), SIPKAXXVPTEL (SEQ ID NO: 6563):RPVQ-AA17-RKI (SEQ ID NO: 6596), HVTKPTXAPTKL (SEQ ID NO: 6511):RPVQ-AA17-RKI (SEQ ID NO: 6596), YVPKPXXAPTKL (SEQ ID NO: 6583):RPVQ-AA17-RKI (SEQ ID NO: 6596), TVPKPXXAPTQL (SEQ ID NO: 6575):RPVQ-AA17-RKI (SEQ ID NO: 6596), AVPKAXXAPTKL (SEQ ID NO: 6479):RPVQ-AA17-RKI (SEQ ID NO: 6596), KVGKAXXVPTKL (SEQ ID NO: 6543):RPVQ-AA17-RKI (SEQ ID NO: 6596), KASKAXXVPTKL (SEQ ID NO: 6527):RPVQ-AA17-RKI (SEQ ID NO: 6596), GSAGPXXTPTKM (SEQ ID NO: 6497):RPVQ-AA17-RKI (SEQ ID NO: 6596), AAPASXXVPARL (SEQ ID NO: 6458):RPVQ-AA17-RKI (SEQ ID NO: 6596), STPPTXXVPTRL (SEQ ID NO: 6573):RPVQ-AA17-RKI (SEQ ID NO: 6596), HVPKPXXAPTKL (SEQ ID NO: 6503):RPVQ-AA17-RKI (SEQ ID NO: 6596), RVPSTXXAPVKT (SEQ ID NO: 6550):RPVQ-AA17-RKI (SEQ ID NO: 6596), ASAAPXXVPQAL (SEQ ID NO: 6468):RPVQ-AA17-RKI (SEQ ID NO: 6596), ASASPXXVSQDL (SEQ ID NO: 6478):RPVQ-AA17-RKI (SEQ ID NO: 6596), ASASPXXVPQDL (SEQ ID NO: 6476):RPVQ-AA17-RKI (SEQ ID NO: 6596), NDEGLEXVPTEE (SEQ ID NO: 6545):RPVQ-AA17-RKI (SEQ ID NO: 6596), NDEGLEXVPTGQ (SEQ ID NO: 6546):RPVQ-AA17-RKI (SEQ ID NO: 6596) and SSVKXQPSRVHH (SEQ ID NO: 6565):RPVQ-AA17-RKI (SEQ ID NO: 6596); and wherein $AA^{17}$ is selected from the group consisting of G, A, V, L, I, P, F, M, W, T and S (in particular is selected from the group consisting of M, I, L, V and T).

In certain embodiments, the triplet PEP7:PEP3:PEP1 is selected from the group consisting of GIPEPXX (SEQ ID NO: 6440):VPT:SAIS (SEQ ID NO: 6360), HVTKPTX (SEQ ID NO: 6443):VPT:SAIS (SEQ ID NO: 6360), YVPKPXX (SEQ ID NO: 6454):VPT:SAIS (SEQ ID NO: 6360), TVPKPXX (SEQ ID NO: 6453):VPT:SAIS (SEQ ID NO: 6360), AVPKAXX (SEQ ID NO: 6439):VPT:SAIS (SEQ ID NO: 6360), KVGKAXX (SEQ ID NO: 6446):VPT:SAIS (SEQ ID NO: 6360), KASKAXX (SEQ ID NO: 6444):VPT:SAIS (SEQ ID NO: 6360), GSAGPXX (SEQ ID NO: 6441):VPT:SAIS (SEQ ID NO: 6360), AAPASXX (SEQ ID NO: 6436):VPT:SAIS (SEQ ID NO: 6360), STPPTXX (SEQ ID NO: 6452):VPT:SAIS (SEQ ID NO: 6360), HVPKPXX (SEQ ID NO: 6442):VPT:SAIS (SEQ ID NO: 6360), RVPSTXX (SEQ ID NO: 6449):VPT:SAIS (SEQ ID NO: 6360), ASAAPXX (SEQ ID NO: 6437):VPT:SAIS (SEQ ID NO: 6360), ASASPXX (SEQ ID NO: 6438):VPT:SAIS (SEQ ID NO: 6360), GIPEPXX (SEQ ID NO: 6440):VPE:SAIS (SEQ ID NO: 6360), HVTKPTX (SEQ ID NO: 6443):APT:SAIS (SEQ ID NO: 6360), YVPKPXX (SEQ ID NO: 6454):APT:SAIS (SEQ ID NO: 6360), TVPKPXX (SEQ ID NO: 6453):APT:SAIS (SEQ ID NO: 6360), AVPKAXX (SEQ ID NO: 6439):APT:SAIS (SEQ ID NO: 6360), GSAGPXX (SEQ ID NO: 6441):TPT:SAIS (SEQ ID NO: 6360), AAPASXX (SEQ ID NO: 6436):VPA:SAIS (SEQ ID NO: 6360), HVPKPXX (SEQ ID NO: 6442):APT:SAIS (SEQ ID NO: 6360), RVPSTXX (SEQ ID NO: 6449):APV:SAIS (SEQ ID NO: 6360), ASAAPXX (SEQ ID NO: 6437):VPQ:SAIS (SEQ ID NO: 6360), ASASPXX (SEQ ID NO: 6438):VSQ:SAIS (SEQ ID NO: 6360), ASASPXX (SEQ ID NO: 6438):VPQ:SAIS (SEQ ID NO: 6360), SSVKXQP (SEQ ID NO: 6451):SRV:SAIS (SEQ ID NO: 6360), RNVQXRP (SEQ ID NO: 6448):TQV:SAIS (SEQ ID NO: 6360), KIPKAXX (SEQ ID NO: 6445):VPE:SSLS (SEQ ID NO: 6365), SIPKAXX (SEQ ID NO: 6450):VPE:SSLS (SEQ ID NO: 6365), HVTKPTX (SEQ ID NO: 6443):VPE:SSLS (SEQ ID NO: 6365), YVPKPXX (SEQ ID NO: 6454):VPE:SSLS (SEQ ID NO: 6365), TVPKPXX (SEQ ID NO: 6453):VPE:SSLS (SEQ ID NO: 6365), AVPKAXX (SEQ ID NO: 6439):VPE:SSLS (SEQ ID NO: 6365), KVGKAXX (SEQ ID NO: 6446):VPE:SSLS (SEQ ID NO: 6365), KASKAXX (SEQ ID NO: 6444):VPE:SSLS (SEQ ID NO: 6365), GSAGPXX (SEQ ID NO: 6441):VPE:SSLS (SEQ ID NO: 6365), AAPASXX (SEQ ID NO: 6436):VPE:SSLS (SEQ ID NO: 6365), STPPTXX (SEQ ID NO: 6452):VPE:SSLS (SEQ ID NO: 6365), HVPKPXX (SEQ ID NO: 6442):VPE:SSLS (SEQ ID NO: 6365), RVPSTXX (SEQ ID NO: 6449):VPE:SSLS (SEQ ID NO: 6365), ASAAPXX (SEQ ID NO: 6437):VPE:SSLS (SEQ ID NO: 6365), ASASPXX (SEQ ID NO: 6438):VPE:SSLS (SEQ ID NO: 6365), KIPKAXX (SEQ ID NO: 6445):VPT:SSLS (SEQ ID NO: 6365), SIPKAXX (SEQ ID NO: 6450):VPT:SSLS (SEQ ID NO: 6365), HVTKPTX (SEQ ID NO: 6443):APT:SSLS (SEQ ID NO: 6365), YVPKPXX (SEQ ID NO: 6454):APT:SSLS (SEQ ID NO: 6365), TVPKPXX (SEQ ID NO: 6453):APT:SSLS (SEQ ID NO: 6365), AVPKAXX (SEQ ID NO: 6439):APT:SSLS (SEQ ID NO: 6365), KVGKAXX (SEQ ID NO: 6446):VPT:SSLS (SEQ ID NO: 6365), KASKAXX (SEQ ID NO: 6444):VPT:SSLS (SEQ ID NO: 6365), GSAGPXX (SEQ ID NO: 6441):TPT:SSLS (SEQ ID NO: 6365), AAPASXX (SEQ ID NO: 6436):VPA:SSLS (SEQ ID NO: 6365), STPPTXX (SEQ ID NO: 6452):VPT:SSLS (SEQ ID NO: 6365), HVPKPXX (SEQ ID NO: 6442):APT:

SSLS (SEQ ID NO: 6365), RVPSTXX (SEQ ID NO: 6449):APV:SSLS (SEQ ID NO: 6365), ASAAPXX (SEQ ID NO: 6437):VPQ:SSLS (SEQ ID NO: 6365), ASASPXX (SEQ ID NO: 6438):VSQ:SSLS (SEQ ID NO: 6365), ASASPXX (SEQ ID NO: 6438):VPQ:SSLS (SEQ ID NO: 6365), NDEGLEX (SEQ ID NO: 6447):VPT:SSLS (SEQ ID NO: 6365), SSVKXQP (SEQ ID NO: 6451):SRV:SSLS (SEQ ID NO: 6365), RNVQXRP (SEQ ID NO: 6448):TQV:SSLS (SEQ ID NO: 6365), KIPKAXX (SEQ ID NO: 6445):APT:NAIS (SEQ ID NO: 6357), GIPEPXX (SEQ ID NO: 6440):APT:NAIS (SEQ ID NO: 6357), SIPKAXX (SEQ ID NO: 6450):APT:NAIS (SEQ ID NO: 6357), AVPKAXX (SEQ ID NO: 6439):APT:NAIS (SEQ ID NO: 6357), KVGKAXX (SEQ ID NO: 6446):APT:NAIS (SEQ ID NO: 6357), KASKAXX (SEQ ID NO: 6444):APT:NAIS (SEQ ID NO: 6357), GSAGPXX (SEQ ID NO: 6441):APT:NAIS (SEQ ID NO: 6357), AAPASXX (SEQ ID NO: 6436):APT:NAIS (SEQ ID NO: 6357), STPPTXX (SEQ ID NO: 6452):APT:NAIS (SEQ ID NO: 6357), RVPSTXX (SEQ ID NO: 6449):APT:NAIS (SEQ ID NO: 6357), ASAAPXX (SEQ ID NO: 6437):APT:NAIS (SEQ ID NO: 6357), ASASPXX (SEQ ID NO: 6438):APT:NAIS (SEQ ID NO: 6357), KIPKAXX (SEQ ID NO: 6445):VPT:NAIS (SEQ ID NO: 6357), GIPEPXX (SEQ ID NO: 6440):VPE:NAIS (SEQ ID NO: 6357), SIPKAXX (SEQ ID NO: 6450):VPT:NAIS (SEQ ID NO: 6357), KVGKAXX (SEQ ID NO: 6446):VPT:NAIS (SEQ ID NO: 6357), KASKAXX (SEQ ID NO: 6444):VPT:NAIS (SEQ ID NO: 6357), GSAGPXX (SEQ ID NO: 6441):TPT:NAIS (SEQ ID NO: 6357), AAPASXX (SEQ ID NO: 6436):VPA:NAIS (SEQ ID NO: 6357), STPPTXX (SEQ ID NO: 6452):VPT:NAIS (SEQ ID NO: 6357), RVPSTXX (SEQ ID NO: 6449):APV:NAIS (SEQ ID NO: 6357), ASAAPXX (SEQ ID NO: 6437):VPQ:NAIS (SEQ ID NO: 6357), ASASPXX (SEQ ID NO: 6438):VSQ:NAIS (SEQ ID NO: 6357), ASASPXX (SEQ ID NO: 6438):VPQ:NAIS (SEQ ID NO: 6357), NDEGLEX (SEQ ID NO: 6447):VPT:NAIS (SEQ ID NO: 6357), SSVKXQP (SEQ ID NO: 6451):SRV:NAIS (SEQ ID NO: 6357), RNVQXRP (SEQ ID NO: 6448):TQV:NAIS (SEQ ID NO: 6357), KIPKAXX (SEQ ID NO: 6445):APT:SATS (SEQ ID NO: 6361), GIPEPXX (SEQ ID NO: 6440):APT:SATS (SEQ ID NO: 6361), SIPKAXX (SEQ ID NO: 6450):APT:SATS (SEQ ID NO: 6361), HVTKPTX (SEQ ID NO: 6443):APT:SATS (SEQ ID NO: 6361), YVPKPXX (SEQ ID NO: 6454):APT:SATS (SEQ ID NO: 6361), TVPKPXX (SEQ ID NO: 6453):APT:SATS (SEQ ID NO: 6361), KVGKAXX (SEQ ID NO: 6446):APT:SATS (SEQ ID NO: 6361), KASKAXX (SEQ ID NO: 6444):APT:SATS (SEQ ID NO: 6361), GSAGPXX (SEQ ID NO: 6441):APT:SATS (SEQ ID NO: 6361), AAPASXX (SEQ ID NO: 6436):APT:SATS (SEQ ID NO: 6361), STPPTXX (SEQ ID NO: 6452):APT:SATS (SEQ ID NO: 6361), HVPKPXX (SEQ ID NO: 6442):APT:SATS (SEQ ID NO: 6361), RVPSTXX (SEQ ID NO: 6449):APT:SATS (SEQ ID NO: 6361), ASAAPXX (SEQ ID NO: 6437):APT:SATS (SEQ ID NO: 6361), ASASPXX (SEQ ID NO: 6438):APT:SATS (SEQ ID NO: 6361), KIPKAXX (SEQ ID NO: 6445):VPT:SATS (SEQ ID NO: 6361), GIPEPXX (SEQ ID NO: 6440):VPE:SATS (SEQ ID NO: 6361), SIPKAXX (SEQ ID NO: 6450):VPT:SATS (SEQ ID NO: 6361), KVGKAXX (SEQ ID NO: 6446):VPT:SATS (SEQ ID NO: 6361), KASKAXX (SEQ ID NO: 6444):VPT:SATS (SEQ ID NO: 6361), GSAGPXX (SEQ ID NO: 6441):TPT:SATS (SEQ ID NO: 6361), AAPASXX (SEQ ID NO: 6436):VPA:SATS (SEQ ID NO: 6361), STPPTXX (SEQ ID NO: 6452):VPT:SATS (SEQ ID NO: 6361), RVPSTXX (SEQ ID NO: 6449):APV:SATS (SEQ ID NO: 6361), ASAAPXX (SEQ ID NO: 6437):VPQ:SATS (SEQ ID NO: 6361), ASASPXX (SEQ ID NO: 6438):VSQ:SATS (SEQ ID NO: 6361), ASASPXX (SEQ ID NO: 6438):VPQ:SATS (SEQ ID NO: 6361), NDEGLEX (SEQ ID NO: 6447):VPT:SATS (SEQ ID NO: 6361), SSVKXQP (SEQ ID NO: 6451):SRV:SATS (SEQ ID NO: 6361), RNVQXRP (SEQ ID NO: 6448):TQV:SATS (SEQ ID NO: 6361), KIPKAXX (SEQ ID NO: 6445):VPT:SPIS (SEQ ID NO: 6364), GIPEPXX (SEQ ID NO: 6440):VPT:SPIS (SEQ ID NO: 6364), SIPKAXX (SEQ ID NO: 6450):VPT:SPIS (SEQ ID NO: 6364), HVTKPTX (SEQ ID NO: 6443):VPT:SPIS (SEQ ID NO: 6364), YVPKPXX (SEQ ID NO: 6454):VPT:SPIS (SEQ ID NO: 6364), TVPKPXX (SEQ ID NO: 6453):VPT:SPIS (SEQ ID NO: 6364), AVPKAXX (SEQ ID NO: 6439):VPT:SPIS (SEQ ID NO: 6364), KASKAXX (SEQ ID NO: 6444):VPT:SPIS (SEQ ID NO: 6364), GSAGPXX (SEQ ID NO: 6441):VPT:SPIS (SEQ ID NO: 6364), AAPASXX (SEQ ID NO: 6436):VPT:SPIS (SEQ ID NO: 6364), STPPTXX (SEQ ID NO: 6452):VPT:SPIS (SEQ ID NO: 6364), HVPKPXX (SEQ ID NO: 6442):VPT:SPIS (SEQ ID NO: 6364), RVPSTXX (SEQ ID NO: 6449):VPT:SPIS (SEQ ID NO: 6364), ASAAPXX (SEQ ID NO: 6437):VPT:SPIS (SEQ ID NO: 6364), ASASPXX (SEQ ID NO: 6438):VPT:SPIS (SEQ ID NO: 6364), GIPEPXX (SEQ ID NO: 6440):VPE:SPIS (SEQ ID NO: 6364), HVTKPTX (SEQ ID NO: 6443):APT:SPIS (SEQ ID NO: 6364), YVPKPXX (SEQ ID NO: 6454):APT:SPIS (SEQ ID NO: 6364), TVPKPXX (SEQ ID NO: 6453):APT:SPIS (SEQ ID NO: 6364), AVPKAXX (SEQ ID NO: 6439):APT:SPIS (SEQ ID NO: 6364), GSAGPXX (SEQ ID NO: 6441):TPT:SPIS (SEQ ID NO: 6364), AAPASXX (SEQ ID NO: 6436):VPA:SPIS (SEQ ID NO: 6364), HVPKPXX (SEQ ID NO: 6442):APT:SPIS (SEQ ID NO: 6364), RVPSTXX (SEQ ID NO: 6449):APV:SPIS (SEQ ID NO: 6364), ASAAPXX (SEQ ID NO: 6437):VPQ:SPIS (SEQ ID NO: 6364), ASASPXX (SEQ ID NO: 6438):VSQ:SPIS (SEQ ID NO: 6364), ASASPXX (SEQ ID NO: 6438):VPQ:SPIS (SEQ ID NO: 6364), SSVKXQP (SEQ ID NO: 6451):SRV:SPIS (SEQ ID NO: 6364), RNVQXRP (SEQ ID NO: 6448):TQV:SPIS (SEQ ID NO: 6364), KIPKAXX (SEQ ID NO: 6445):VPT:EPIS (SEQ ID NO: 6353), GIPEPXX (SEQ ID NO: 6440):VPT:EPIS (SEQ ID NO: 6353), SIPKAXX (SEQ ID NO: 6450):VPT:EPIS (SEQ ID NO: 6353), HVTKPTX (SEQ ID NO: 6443):VPT:EPIS (SEQ ID NO: 6353), YVPKPXX (SEQ ID NO: 6454):VPT:EPIS (SEQ ID NO: 6353), TVPKPXX (SEQ ID NO: 6453):VPT:EPIS (SEQ ID NO: 6353), AVPKAXX (SEQ ID NO: 6439):VPT:EPIS (SEQ ID NO: 6353), KVGKAXX (SEQ ID NO: 6446):VPT:EPIS (SEQ ID NO: 6353), GSAGPXX (SEQ ID NO: 6441):VPT:EPIS (SEQ ID NO: 6353), AAPASXX (SEQ ID NO: 6436):VPT:EPIS (SEQ ID NO: 6353), STPPTXX (SEQ ID NO: 6452):VPT:EPIS (SEQ ID NO: 6353), HVPKPXX (SEQ ID NO: 6442):VPT:EPIS (SEQ ID NO: 6353), RVPSTXX (SEQ ID NO: 6449):VPT:EPIS (SEQ ID NO: 6353), ASAAPXX (SEQ ID NO: 6437):VPT:EPIS (SEQ ID NO: 6353), ASASPXX (SEQ ID NO: 6438):VPT:EPIS (SEQ ID NO: 6353), GIPEPXX (SEQ ID NO: 6440):VPE:EPIS (SEQ ID NO: 6353), HVTKPTX (SEQ ID NO: 6443):APT:EPIS (SEQ ID NO: 6353), YVPKPXX (SEQ ID NO: 6454):APT:EPIS (SEQ ID NO: 6353), TVPKPXX (SEQ ID NO: 6453):APT:EPIS (SEQ ID NO: 6353), AVPKAXX (SEQ ID NO: 6439):APT:EPIS (SEQ ID NO: 6353), GSAGPXX (SEQ ID NO: 6441):TPT:EPIS (SEQ ID NO: 6353), AAPASXX (SEQ ID NO: 6436):VPA:EPIS (SEQ ID NO: 6353), HVPKPXX (SEQ ID NO: 6442):APT:EPIS (SEQ ID NO: 6353), RVPSTXX (SEQ ID NO: 6449):APV:EPIS (SEQ ID NO: 6353), ASAAPXX (SEQ ID NO: 6437):VPQ:EPIS (SEQ ID NO: 6353),

ASASPXX (SEQ ID NO: 6438):VSQ:EPIS (SEQ ID NO: 6353), ASASPXX (SEQ ID NO: 6438):VPQ:EPIS (SEQ ID NO: 6353), SSVKXQP (SEQ ID NO: 6451):SRV:EPIS (SEQ ID NO: 6353), RNVQXRP (SEQ ID NO: 6448):TQV:EPIS (SEQ ID NO: 6353), KIPKAXX (SEQ ID NO: 6445):TPT:SPIN (SEQ ID NO: 6363), GIPEPXX (SEQ ID NO: 6440):TPT:SPIN (SEQ ID NO: 6363), SIPKAXX (SEQ ID NO: 6450):TPT:SPIN (SEQ ID NO: 6363), HVTKPTX (SEQ ID NO: 6443):TPT:SPIN (SEQ ID NO: 6363), YVPKPXX (SEQ ID NO: 6454):TPT:SPIN (SEQ ID NO: 6363), TVPKPXX (SEQ ID NO: 6453):TPT:SPIN (SEQ ID NO: 6363), AVPKAXX (SEQ ID NO: 6439):TPT:SPIN (SEQ ID NO: 6363), KVGKAXX (SEQ ID NO: 6446):TPT:SPIN (SEQ ID NO: 6363), KASKAXX (SEQ ID NO: 6444):TPT:SPIN (SEQ ID NO: 6363), AAPASXX (SEQ ID NO: 6436):TPT:SPIN (SEQ ID NO: 6363), STPPTXX (SEQ ID NO: 6452):TPT:SPIN (SEQ ID NO: 6363), HVPKPXX (SEQ ID NO: 6442):TPT:SPIN (SEQ ID NO: 6363), RVPSTXX (SEQ ID NO: 6449):TPT:SPIN (SEQ ID NO: 6363), ASAAPXX (SEQ ID NO: 6437):TPT:SPIN (SEQ ID NO: 6363), ASASPXX (SEQ ID NO: 6438):TPT:SPIN (SEQ ID NO: 6363), KIPKAXX (SEQ ID NO: 6445):VPT:SPIN (SEQ ID NO: 6363), GIPEPXX (SEQ ID NO: 6440):VPE:SPIN (SEQ ID NO: 6363), SIPKAXX (SEQ ID NO: 6450):VPT:SPIN (SEQ ID NO: 6363), HVTKPTX (SEQ ID NO: 6443):APT:SPIN (SEQ ID NO: 6363), YVPKPXX (SEQ ID NO: 6454):APT:SPIN (SEQ ID NO: 6363), TVPKPXX (SEQ ID NO: 6453):APT:SPIN (SEQ ID NO: 6363), AVPKAXX (SEQ ID NO: 6439):APT:SPIN (SEQ ID NO: 6363), KVGKAXX (SEQ ID NO: 6446):VPT:SPIN (SEQ ID NO: 6363), KASKAXX (SEQ ID NO: 6444):VPT:SPIN (SEQ ID NO: 6363), AAPASXX (SEQ ID NO: 6436):VPA:SPIN (SEQ ID NO: 6363), STPPTXX (SEQ ID NO: 6452):VPT:SPIN (SEQ ID NO: 6363), HVPKPXX (SEQ ID NO: 6442):APT:SPIN (SEQ ID NO: 6363), RVPSTXX (SEQ ID NO: 6449):APV:SPIN (SEQ ID NO: 6363), ASAAPXX (SEQ ID NO: 6437):VPQ:SPIN (SEQ ID NO: 6363), ASASPXX (SEQ ID NO: 6438):VSQ:SPIN (SEQ ID NO: 6363), ASASPXX (SEQ ID NO: 6438):VPQ:SPIN (SEQ ID NO: 6363), NDEGLEX (SEQ ID NO: 6447):VPT:SPIN (SEQ ID NO: 6363), SSVKXQP (SEQ ID NO: 6451):SRV:SPIN (SEQ ID NO: 6363), RNVQXRP (SEQ ID NO: 6448):TQV:SPIN (SEQ ID NO: 6363), KIPKAXX (SEQ ID NO: 6445):VPA:SPIS (SEQ ID NO: 6364), GIPEPXX (SEQ ID NO: 6440):VPA:SPIS (SEQ ID NO: 6364), SIPKAXX (SEQ ID NO: 6450):VPA:SPIS (SEQ ID NO: 6364), HVTKPTX (SEQ ID NO: 6443):VPA:SPIS (SEQ ID NO: 6364), YVPKPXX (SEQ ID NO: 6454):VPA:SPIS (SEQ ID NO: 6364), TVPKPXX (SEQ ID NO: 6453):VPA:SPIS (SEQ ID NO: 6364), AVPKAXX (SEQ ID NO: 6439):VPA:SPIS (SEQ ID NO: 6364), KVGKAXX (SEQ ID NO: 6446):VPA:SPIS (SEQ ID NO: 6364), KASKAXX (SEQ ID NO: 6444):VPA:SPIS (SEQ ID NO: 6364), GSAGPXX (SEQ ID NO: 6441):VPA:SPIS (SEQ ID NO: 6364), STPPTXX (SEQ ID NO: 6452):VPA:SPIS (SEQ ID NO: 6364), HVPKPXX (SEQ ID NO: 6442):VPA:SPIS (SEQ ID NO: 6364), RVPSTXX (SEQ ID NO: 6449):VPA:SPIS (SEQ ID NO: 6364), ASAAPXX (SEQ ID NO: 6437):VPA:SPIS (SEQ ID NO: 6364), ASASPXX (SEQ ID NO: 6438):VPA:SPIS (SEQ ID NO: 6364), KVGKAXX (SEQ ID NO: 6446):VPT:SPIS (SEQ ID NO: 6364), NDEGLEX (SEQ ID NO: 6447):VPT:SPIS (SEQ ID NO: 6364), KIPKAXX (SEQ ID NO: 6445):APV:KPLS (SEQ ID NO: 6356), GIPEPXX (SEQ ID NO: 6440):APV:KPLS (SEQ ID NO: 6356), SIPKAXX (SEQ ID NO: 6450):APV:KPLS (SEQ ID NO: 6356), HVTKPTX (SEQ ID NO: 6443):APV:KPLS (SEQ ID NO: 6356), YVPKPXX (SEQ ID NO: 6454):APV:KPLS (SEQ ID NO: 6356), TVPKPXX (SEQ ID NO: 6453):APV:KPLS (SEQ ID NO: 6356), AVPKAXX (SEQ ID NO: 6439):APV:KPLS (SEQ ID NO: 6356), KVGKAXX (SEQ ID NO: 6446):APV:KPLS (SEQ ID NO: 6356), KASKAXX (SEQ ID NO: 6444):APV:KPLS (SEQ ID NO: 6356), GSAGPXX (SEQ ID NO: 6441):APV:KPLS (SEQ ID NO: 6356), AAPASXX (SEQ ID NO: 6436):APV:KPLS (SEQ ID NO: 6356), STPPTXX (SEQ ID NO: 6452):APV:KPLS (SEQ ID NO: 6356), HVPKPXX (SEQ ID NO: 6442):APV:KPLS (SEQ ID NO: 6356), ASAAPXX (SEQ ID NO: 6437):APV:KPLS (SEQ ID NO: 6356), ASASPXX (SEQ ID NO: 6438):APV:KPLS (SEQ ID NO: 6356), KIPKAXX (SEQ ID NO: 6445):VPT:KPLS (SEQ ID NO: 6356), GIPEPXX (SEQ ID NO: 6440):VPE:KPLS (SEQ ID NO: 6356), SIPKAXX (SEQ ID NO: 6450):VPT:KPLS (SEQ ID NO: 6356), HVTKPTX (SEQ ID NO: 6443):APT:KPLS (SEQ ID NO: 6356), YVPKPXX (SEQ ID NO: 6454):APT:KPLS (SEQ ID NO: 6356), TVPKPXX (SEQ ID NO: 6453):APT:KPLS (SEQ ID NO: 6356), AVPKAXX (SEQ ID NO: 6439):APT:KPLS (SEQ ID NO: 6356), KVGKAXX (SEQ ID NO: 6446):VPT:KPLS (SEQ ID NO: 6356), KASKAXX (SEQ ID NO: 6444):VPT:KPLS (SEQ ID NO: 6356), GSAGPXX (SEQ ID NO: 6441):TPT:KPLS (SEQ ID NO: 6356), AAPASXX (SEQ ID NO: 6436):VPA:KPLS (SEQ ID NO: 6356), STPPTXX (SEQ ID NO: 6452):VPT:KPLS (SEQ ID NO: 6356), HVPKPXX (SEQ ID NO: 6442):APT:KPLS (SEQ ID NO: 6356), ASAAPXX (SEQ ID NO: 6437):VPQ:KPLS (SEQ ID NO: 6356), ASASPXX (SEQ ID NO: 6438):VSQ:KPLS (SEQ ID NO: 6356), ASASPXX (SEQ ID NO: 6438):VPQ:KPLS (SEQ ID NO: 6356), NDEGLEX (SEQ ID NO: 6447):VPT:KPLS (SEQ ID NO: 6356), SSVKXQP (SEQ ID NO: 6451):SRV:KPLS (SEQ ID NO: 6356), RNVQXRP (SEQ ID NO: 6448):TQV:KPLS (SEQ ID NO: 6356), KIPKAXX (SEQ ID NO: 6445):VPQ:EPLP (SEQ ID NO: 6354), GIPEPXX (SEQ ID NO: 6440):VPQ:EPLP (SEQ ID NO: 6354), SIPKAXX (SEQ ID NO: 6450):VPQ:EPLP (SEQ ID NO: 6354), HVTKPTX (SEQ ID NO: 6443):VPQ:EPLP (SEQ ID NO: 6354), YVPKPXX (SEQ ID NO: 6454):VPQ:EPLP (SEQ ID NO: 6354), TVPKPXX (SEQ ID NO: 6453):VPQ:EPLP (SEQ ID NO: 6354), AVPKAXX (SEQ ID NO: 6439):VPQ:EPLP (SEQ ID NO: 6354), KVGKAXX (SEQ ID NO: 6446):VPQ:EPLP (SEQ ID NO: 6354), KASKAXX (SEQ ID NO: 6444):VPQ:EPLP (SEQ ID NO: 6354), GSAGPXX (SEQ ID NO: 6441):VPQ:EPLP (SEQ ID NO: 6354), AAPASXX (SEQ ID NO: 6436):VPQ:EPLP (SEQ ID NO: 6354), STPPTXX (SEQ ID NO: 6452):VPQ:EPLP (SEQ ID NO: 6354), HVPKPXX (SEQ ID NO: 6442):VPQ:EPLP (SEQ ID NO: 6354), RVPSTXX (SEQ ID NO: 6449):VPQ:EPLP (SEQ ID NO: 6354), ASASPXX (SEQ ID NO: 6438):VPQ:EPLP (SEQ ID NO: 6354), KIPKAXX (SEQ ID NO: 6445):VPT:EPLP (SEQ ID NO: 6354), GIPEPXX (SEQ ID NO: 6440):VPE:EPLP (SEQ ID NO: 6354), SIPKAXX (SEQ ID NO: 6450):VPT:EPLP (SEQ ID NO: 6354), HVTKPTX (SEQ ID NO: 6443):APT:EPLP (SEQ ID NO: 6354), YVPKPXX (SEQ ID NO: 6454):APT:EPLP (SEQ ID NO: 6354), TVPKPXX (SEQ ID NO: 6453):APT:EPLP (SEQ ID NO: 6354), AVPKAXX (SEQ ID NO: 6439):APT:EPLP (SEQ ID NO: 6354), KVGKAXX (SEQ ID NO: 6446):VPT:EPLP (SEQ ID NO: 6354), KASKAXX (SEQ ID NO: 6444):VPT:EPLP (SEQ ID NO: 6354), GSAGPXX (SEQ ID NO: 6441):TPT:EPLP (SEQ ID NO: 6354), AAPASXX (SEQ ID NO: 6436):VPA:EPLP (SEQ ID NO: 6354), STPPTXX (SEQ ID NO: 6452):VPT:EPLP (SEQ ID NO: 6354), HVPKPXX (SEQ ID NO: 6442):APT:EPLP (SEQ ID NO: 6354), RVPSTXX (SEQ ID NO: 6449):APV:EPLP (SEQ ID NO: 6354),

ASASPXX (SEQ ID NO: 6438):VSQ:EPLP (SEQ ID NO: 6354), NDEGLEX (SEQ ID NO: 6447):VPT:EPLP (SEQ ID NO: 6354), SSVKXQP (SEQ ID NO: 6451):SRV:EPLP (SEQ ID NO: 6354), RNVQXRP (SEQ ID NO: 6448):TQV:EPLP (SEQ ID NO: 6354), KIPKAXX (SEQ ID NO: 6445):VSQ:EPLT (SEQ ID NO: 6355), GIPEPXX (SEQ ID NO: 6440):VSQ:EPLT (SEQ ID NO: 6355), SIPKAXX (SEQ ID NO: 6450):VSQ:EPLT (SEQ ID NO: 6355), HVTKPTX (SEQ ID NO: 6443):VSQ:EPLT (SEQ ID NO: 6355), YVPKPXX (SEQ ID NO: 6454):VSQ:EPLT (SEQ ID NO: 6355), TVPKPXX (SEQ ID NO: 6453):VSQ:EPLT (SEQ ID NO: 6355), AVPKAXX (SEQ ID NO: 6439):VSQ:EPLT (SEQ ID NO: 6355), KVGKAXX (SEQ ID NO: 6446):VSQ:EPLT (SEQ ID NO: 6355), KASKAXX (SEQ ID NO: 6444):VSQ:EPLT (SEQ ID NO: 6355), GSAGPXX (SEQ ID NO: 6441):VSQ:EPLT (SEQ ID NO: 6355), AAPASXX (SEQ ID NO: 6436):VSQ:EPLT (SEQ ID NO: 6355), STPPTXX (SEQ ID NO: 6452):VSQ:EPLT (SEQ ID NO: 6355), HVPKPXX (SEQ ID NO: 6442):VSQ:EPLT (SEQ ID NO: 6355), RVPSTXX (SEQ ID NO: 6449):VSQ:EPLT (SEQ ID NO: 6355), ASAAPXX (SEQ ID NO: 6437):VSQ:EPLT (SEQ ID NO: 6355), ASASPXX (SEQ ID NO: 6438):VSQ:EPLT (SEQ ID NO: 6355), KIPKAXX (SEQ ID NO: 6445):VPT:EPLT (SEQ ID NO: 6355), GIPEPXX (SEQ ID NO: 6440):VPE:EPLT (SEQ ID NO: 6355), SIPKAXX (SEQ ID NO: 6450):VPT:EPLT (SEQ ID NO: 6355), HVTKPTX (SEQ ID NO: 6443):APT:EPLT (SEQ ID NO: 6355), YVPKPXX (SEQ ID NO: 6454):APT:EPLT (SEQ ID NO: 6355), TVPKPXX (SEQ ID NO: 6453):APT:EPLT (SEQ ID NO: 6355), AVPKAXX (SEQ ID NO: 6439):APT:EPLT (SEQ ID NO: 6355), KVGKAXX (SEQ ID NO: 6446):VPT:EPLT (SEQ ID NO: 6355), KASKAXX (SEQ ID NO: 6444):VPT:EPLT (SEQ ID NO: 6355), GSAGPXX (SEQ ID NO: 6441):TPT:EPLT (SEQ ID NO: 6355), AAPASXX (SEQ ID NO: 6436):VPA:EPLT (SEQ ID NO: 6355), STPPTXX (SEQ ID NO: 6452):VPT:EPLT (SEQ ID NO: 6355), HVPKPXX (SEQ ID NO: 6442):APT:EPLT (SEQ ID NO: 6355), RVPSTXX (SEQ ID NO: 6449):APV:EPLT (SEQ ID NO: 6355), ASAAPXX (SEQ ID NO: 6437):VPQ:EPLT (SEQ ID NO: 6355), NDEGLEX (SEQ ID NO: 6447):VPT:EPLT (SEQ ID NO: 6355), SSVKXQP (SEQ ID NO: 6451):SRV:EPLT (SEQ ID NO: 6355), RNVQXRP (SEQ ID NO: 6448):TQV:EPLT (SEQ ID NO: 6355), KIPKAXX (SEQ ID NO: 6445):VPQ:EPLT (SEQ ID NO: 6355), GIPEPXX (SEQ ID NO: 6440):VPQ:EPLT (SEQ ID NO: 6355), SIPKAXX (SEQ ID NO: 6450):VPQ:EPLT (SEQ ID NO: 6355), HVTKPTX (SEQ ID NO: 6443):VPQ:EPLT (SEQ ID NO: 6355), YVPKPXX (SEQ ID NO: 6454):VPQ:EPLT (SEQ ID NO: 6355), TVPKPXX (SEQ ID NO: 6453):VPQ:EPLT (SEQ ID NO: 6355), AVPKAXX (SEQ ID NO: 6439):VPQ:EPLT (SEQ ID NO: 6355), KVGKAXX (SEQ ID NO: 6446):VPQ:EPLT (SEQ ID NO: 6355), KASKAXX (SEQ ID NO: 6444):VPQ:EPLT (SEQ ID NO: 6355), GSAGPXX (SEQ ID NO: 6441):VPQ:EPLT (SEQ ID NO: 6355), AAPASXX (SEQ ID NO: 6436):VPQ:EPLT (SEQ ID NO: 6355), STPPTXX (SEQ ID NO: 6452):VPQ:EPLT (SEQ ID NO: 6355), HVPKPXX (SEQ ID NO: 6442):VPQ:EPLT (SEQ ID NO: 6355), RVPSTXX (SEQ ID NO: 6449):VPQ:EPLT (SEQ ID NO: 6355), ASASPXX (SEQ ID NO: 6438):VPQ:EPLT (SEQ ID NO: 6355), NDEGLEX (SEQ ID NO: 6447):VPT:SNIT (SEQ ID NO: 6362), GIPEPXX (SEQ ID NO: 6440):VPE:SNIT (SEQ ID NO: 6362), HVTKPTX (SEQ ID NO: 6443):APT:SNIT (SEQ ID NO: 6362), YVPKPXX (SEQ ID NO: 6454):APT:SNIT (SEQ ID NO: 6362), TVPKPXX (SEQ ID NO: 6453):APT:SNIT (SEQ ID NO: 6362), AVPKAXX (SEQ ID NO: 6439):APT:SNIT (SEQ ID NO: 6362), GSAGPXX (SEQ ID NO: 6441):TPT:SNIT (SEQ ID NO: 6362), AAPASXX (SEQ ID NO: 6436):VPA:SNIT (SEQ ID NO: 6362), HVPKPXX (SEQ ID NO: 6442):APT:SNIT (SEQ ID NO: 6362), RVPSTXX (SEQ ID NO: 6449):APV:SNIT (SEQ ID NO: 6362), ASAAPXX (SEQ ID NO: 6437):VPQ:SNIT (SEQ ID NO: 6362), ASASPXX (SEQ ID NO: 6438):VSQ:SNIT (SEQ ID NO: 6362), ASASPXX (SEQ ID NO: 6438):VPQ:SNIT (SEQ ID NO: 6362), SSVKXQP (SEQ ID NO: 6451):SRV:SNIT (SEQ ID NO: 6362), RNVQXRP (SEQ ID NO: 6448):TQV:SNIT (SEQ ID NO: 6362), RNVQXRP (SEQ ID NO: 6448):SRV:RSVK (SEQ ID NO: 6359), KIPKAXX (SEQ ID NO: 6445):VPT:RSVK (SEQ ID NO: 6359), GIPEPXX (SEQ ID NO: 6440):VPE:RSVK (SEQ ID NO: 6359), SIPKAXX (SEQ ID NO: 6450):VPT:RSVK (SEQ ID NO: 6359), HVTKPTX (SEQ ID NO: 6443):APT:RSVK (SEQ ID NO: 6359), YVPKPXX (SEQ ID NO: 6454):APT:RSVK (SEQ ID NO: 6359), TVPKPXX (SEQ ID NO: 6453):APT:RSVK (SEQ ID NO: 6359), AVPKAXX (SEQ ID NO: 6439):APT:RSVK (SEQ ID NO: 6359), KVGKAXX (SEQ ID NO: 6446):VPT:RSVK (SEQ ID NO: 6359), KASKAXX (SEQ ID NO: 6444):VPT:RSVK (SEQ ID NO: 6359), GSAGPXX (SEQ ID NO: 6441):TPT:RSVK (SEQ ID NO: 6359), AAPASXX (SEQ ID NO: 6436):VPA:RSVK (SEQ ID NO: 6359), STPPTXX (SEQ ID NO: 6452):VPT:RSVK (SEQ ID NO: 6359), HVPKPXX (SEQ ID NO: 6442):APT:RSVK (SEQ ID NO: 6359), RVPSTXX (SEQ ID NO: 6449):APV:RSVK (SEQ ID NO: 6359), ASAAPXX (SEQ ID NO: 6437):VPQ:RSVK (SEQ ID NO: 6359), ASASPXX (SEQ ID NO: 6438):VSQ:RSVK (SEQ ID NO: 6359), ASASPXX (SEQ ID NO: 6438):VPQ:RSVK (SEQ ID NO: 6359), NDEGLEX (SEQ ID NO: 6447):VPT:RSVK (SEQ ID NO: 6359), RNVQXRP (SEQ ID NO: 6448):TQV:RSVK (SEQ ID NO: 6359), SSVKXQP (SEQ ID NO: 6451):TQV:RPVQ (SEQ ID NO: 6358), KIPKAXX (SEQ ID NO: 6445):VPT:RPVQ (SEQ ID NO: 6358), GIPEPXX (SEQ ID NO: 6440):VPE:RPVQ (SEQ ID NO: 6358), SIPKAXX (SEQ ID NO: 6450):VPT:RPVQ (SEQ ID NO: 6358), HVTKPTX (SEQ ID NO: 6443):APT:RPVQ (SEQ ID NO: 6358), YVPKPXX (SEQ ID NO: 6454):APT:RPVQ (SEQ ID NO: 6358), TVPKPXX (SEQ ID NO: 6453):APT:RPVQ (SEQ ID NO: 6358), AVPKAXX (SEQ ID NO: 6439):APT:RPVQ (SEQ ID NO: 6358), KVGKAXX (SEQ ID NO: 6446):VPT:RPVQ (SEQ ID NO: 6358), KASKAXX (SEQ ID NO: 6444):VPT:RPVQ (SEQ ID NO: 6358), GSAGPXX (SEQ ID NO: 6441):TPT:RPVQ (SEQ ID NO: 6358), AAPASXX (SEQ ID NO: 6436):VPA:RPVQ (SEQ ID NO: 6358), STPPTXX (SEQ ID NO: 6452):VPT:RPVQ (SEQ ID NO: 6358), HVPKPXX (SEQ ID NO: 6442):APT:RPVQ (SEQ ID NO: 6358), RVPSTXX (SEQ ID NO: 6449):APV:RPVQ (SEQ ID NO: 6358), ASAAPXX (SEQ ID NO: 6437):VPQ:RPVQ (SEQ ID NO: 6358), ASASPXX (SEQ ID NO: 6438):VSQ:RPVQ (SEQ ID NO: 6358), ASASPXX (SEQ ID NO: 6438):VPQ:RPVQ (SEQ ID NO: 6358), NDEGLEX (SEQ ID NO: 6447):VPT:RPVQ (SEQ ID NO: 6358) and SSVKXQP (SEQ ID NO: 6451):SRV:RPVQ (SEQ ID NO: 6358).

In certain embodiments, the triplet PEP7:PEP3:PEP12 is selected from the group consisting of GIPEPXX (SEQ ID NO: 6440):VPT:SAIS-AA17-LYL (SEQ ID NO: 6598), HVTKPTX (SEQ ID NO: 6443):VPT:SAIS-AA17-LYL (SEQ ID NO: 6598), YVPKPXX (SEQ ID NO: 6454):VPT:SAIS-AA17-LYL (SEQ ID NO: 6598), TVPKPXX (SEQ ID NO: 6453):VPT:SAIS-AA17-LYL (SEQ ID NO: 6598), AVPKAXX (SEQ ID NO: 6439):VPT:SAIS-AA17-LYL (SEQ ID NO: 6598), KVGKAXX (SEQ ID NO: 6446):VPT:SAIS-AA17-LYL (SEQ ID NO: 6598), KASKAXX (SEQ ID NO: 6444):VPT:SAIS-AA17-LYL (SEQ ID NO: 6598), GSAGPXX (SEQ ID NO: 6441):VPT:SAIS-AA17-LYL (SEQ ID NO: 6598), AAPASXX (SEQ ID NO: 6436):VPT:SAIS-AA17-LYL (SEQ ID NO: 6598), STPPTXX (SEQ ID NO: 6452):VPT:SAIS-AA17-LYL (SEQ ID NO: 6598), HVPKPXX (SEQ ID NO: 6442):VPT:SAIS-AA17-LYL (SEQ ID NO: 6598), RVPSTXX (SEQ ID NO: 6449):VPT:SAIS-AA17-LYL (SEQ ID NO: 6598), ASAAPXX (SEQ ID NO: 6437):VPT:SAIS-AA17-LYL (SEQ ID NO: 6598), ASASPXX (SEQ ID NO: 6438):VPT:SAIS-AA17-LYL (SEQ ID NO: 6598), GIPEPXX (SEQ ID NO: 6440):VPE:SAIS-AA17-LYL (SEQ ID NO: 6598), HVTKPTX (SEQ ID NO: 6443):APT:SAIS-AA17-LYL (SEQ ID NO: 6598), YVPKPXX (SEQ ID NO: 6454):APT:SAIS-AA17-LYL (SEQ ID NO: 6598), TVPKPXX (SEQ ID NO: 6453):APT:SAIS-AA17-LYL (SEQ ID NO: 6598), AVPKAXX (SEQ ID NO: 6439):APT:SAIS-AA17-LYL (SEQ ID NO: 6598), GSAGPXX (SEQ ID NO: 6441):TPT:SAIS-AA17-LYL (SEQ ID NO: 6598), AAPASXX (SEQ ID NO: 6436):VPA:SAIS-AA17-LYL (SEQ ID NO: 6598), HVPKPXX (SEQ ID NO: 6442):APT:SAIS-AA17-LYL (SEQ ID NO: 6598), RVPSTXX (SEQ ID NO: 6449):APV:SAIS-AA17-LYL (SEQ ID NO: 6598), ASAAPXX (SEQ ID NO: 6437):VPQ:SAIS-AA17-LYL (SEQ ID NO: 6598), ASASPXX (SEQ ID NO: 6438):VSQ:SAIS-AA17-LYL (SEQ ID NO: 6598), ASASPXX (SEQ ID NO: 6438):VPQ:SAIS-AA17-LYL (SEQ ID NO: 6598), SSVKXQP (SEQ ID NO: 6451):SRV:SAIS-AA17-LYL (SEQ ID NO: 6598), RNVQXRP (SEQ ID NO: 6448):TQV:SAIS-AA17-LYL (SEQ ID NO: 6598), KIPKAXX (SEQ ID NO: 6445):VPE:SSLS-AA17-LFF (SEQ ID NO: 6605), SIPKAXX (SEQ ID NO: 6450):VPE:SSLS-AA17-LFF (SEQ ID NO: 6605), HVTKPTX (SEQ ID NO: 6443):VPE:SSLS-AA17-LFF (SEQ ID NO: 6605), YVPKPXX (SEQ ID NO: 6454):VPE:SSLS-AA17-LFF (SEQ ID NO: 6605), TVPKPXX (SEQ ID NO: 6453):VPE:SSLS-AA17-LFF (SEQ ID NO: 6605), AVPKAXX (SEQ ID NO: 6439):VPE:SSLS-AA17-LFF (SEQ ID NO: 6605), KVGKAXX (SEQ ID NO: 6446):VPE:SSLS-AA17-LFF (SEQ ID NO: 6605), KASKAXX (SEQ ID NO: 6444):VPE:SSLS-AA17-LFF (SEQ ID NO: 6605), GSAGPXX (SEQ ID NO: 6441):VPE:SSLS-AA17-LFF (SEQ ID NO: 6605), AAPASXX (SEQ ID NO: 6436):VPE:SSLS-AA17-LFF (SEQ ID NO: 6605), STPPTXX (SEQ ID NO: 6452):VPE:SSLS-AA17-LFF (SEQ ID NO: 6605), HVPKPXX (SEQ ID NO: 6442):VPE:SSLS-AA17-LFF (SEQ ID NO: 6605), RVPSTXX (SEQ ID NO: 6449):VPE:SSLS-AA17-LFF (SEQ ID NO: 6605), ASAAPXX (SEQ ID NO: 6437):VPE:SSLS-AA17-LFF (SEQ ID NO: 6605), ASASPXX (SEQ ID NO: 6438):VPE:SSLS-AA17-LFF (SEQ ID NO: 6605), KIPKAXX (SEQ ID NO: 6445):VPT:SSLS-AA17-LFF (SEQ ID NO: 6605), SIPKAXX (SEQ ID NO: 6450):VPT:SSLS-AA17-LFF (SEQ ID NO: 6605), HVTKPTX (SEQ ID NO: 6443):APT:SSLS-AA17-LFF (SEQ ID NO: 6605), YVPKPXX (SEQ ID NO: 6454):APT:SSLS-AA17-LFF (SEQ ID NO: 6605), TVPKPXX (SEQ ID NO: 6453):APT:SSLS-AA17-LFF (SEQ ID NO: 6605), AVPKAXX (SEQ ID NO: 6439):APT:SSLS-AA17-LFF (SEQ ID NO: 6605), KVGKAXX (SEQ ID NO: 6446):VPT:SSLS-AA17-LFF (SEQ ID NO: 6605), KASKAXX (SEQ ID NO: 6444):VPT:SSLS-AA17-LFF (SEQ ID NO: 6605), GSAGPXX (SEQ ID NO: 6441):TPT:SSLS-AA17-LFF (SEQ ID NO: 6605), AAPASXX (SEQ ID NO: 6436):VPA:SSLS-AA17-LFF (SEQ ID NO: 6605), STPPTXX (SEQ ID NO: 6452):VPT:SSLS-AA17-LFF (SEQ ID NO: 6605), HVPKPXX (SEQ ID NO: 6442):APT:SSLS-AA17-LFF (SEQ ID NO: 6605), RVPSTXX (SEQ ID NO: 6449):APV:SSLS-AA17-LFF (SEQ ID NO: 6605), ASAAPXX (SEQ ID NO: 6437):VPQ:SSLS-AA17-LFF (SEQ ID NO: 6605), ASASPXX (SEQ ID NO: 6438):VSQ:SSLS-AA17-LFF (SEQ ID NO: 6605), ASASPXX (SEQ ID NO: 6438):VPQ:SSLS-AA17-LFF (SEQ ID NO: 6605), NDEGLEX (SEQ ID NO: 6447):VPT:SSLS-AA17-LFF (SEQ ID NO: 6605), SSVKXQP (SEQ ID NO: 6451):SRV:SSLS-AA17-LFF (SEQ ID NO: 6605), RNVQXRP (SEQ ID NO: 6448):TQV:SSLS-AA17-LFF (SEQ ID NO: 6605), KIPKAXX (SEQ ID NO: 6445):APT:NAIS-AA17-LYF (SEQ ID NO: 6595), GIPEPXX (SEQ ID NO: 6440):APT:NAIS-AA17-LYF (SEQ ID NO: 6595), SIPKAXX (SEQ ID NO: 6450):APT:NAIS-AA17-LYF (SEQ ID NO: 6595), AVPKAXX (SEQ ID NO: 6439):APT:NAIS-AA17-LYF (SEQ ID NO: 6595), KVGKAXX (SEQ ID NO: 6446):APT:NAIS-AA17-LYF (SEQ ID NO: 6595), KASKAXX (SEQ ID NO: 6444):APT:NAIS-AA17-LYF (SEQ ID NO: 6595), GSAGPXX (SEQ ID NO: 6441):APT:NAIS-AA17-LYF (SEQ ID NO: 6595), AAPASXX (SEQ ID NO: 6436):APT:NAIS-AA17-LYF (SEQ ID NO: 6595), STPPTXX (SEQ ID NO: 6452):APT:NAIS-AA17-LYF (SEQ ID NO: 6595), RVPSTXX (SEQ ID NO: 6449):APT:NAIS-AA17-LYF (SEQ ID NO: 6595), ASAAPXX (SEQ ID NO: 6437):APT:NAIS-AA17-LYF (SEQ ID NO: 6595), ASASPXX (SEQ ID NO: 6438):APT:NAIS-AA17-LYF (SEQ ID NO: 6595), KIPKAXX (SEQ ID NO: 6445):VPT:NAIS-AA17-LYF (SEQ ID NO: 6595), GIPEPXX (SEQ ID NO: 6440):VPE:NAIS-AA17-LYF (SEQ ID NO: 6595), SIPKAXX (SEQ ID NO: 6450):VPT:NAIS-AA17-LYF (SEQ ID NO: 6595), KVGKAXX (SEQ ID NO: 6446):VPT:NAIS-AA17-LYF (SEQ ID NO: 6595), KASKAXX (SEQ ID NO: 6444):VPT:NAIS-AA17-LYF (SEQ ID NO: 6595), GSAGPXX (SEQ ID NO: 6441):TPT:NAIS-AA17-LYF (SEQ ID NO: 6595), AAPASXX (SEQ ID NO: 6436):VPA:NAIS-AA17-LYF (SEQ ID NO: 6595), STPPTXX (SEQ ID NO: 6452):VPT:NAIS-AA17-LYF (SEQ ID NO: 6595), RVPSTXX (SEQ ID NO: 6449):APV:NAIS-AA17-LYF (SEQ ID NO: 6595), ASAAPXX (SEQ ID NO: 6437):VPQ:NAIS-AA17-LYF (SEQ ID NO: 6595), ASASPXX (SEQ ID NO: 6438):VSQ:NAIS-AA17-LYF (SEQ ID NO: 6595), ASASPXX (SEQ ID NO: 6438):VPQ:NAIS-AA17-LYF (SEQ ID NO: 6595), NDEGLEX (SEQ ID NO: 6447):VPT:NAIS-AA17-LYF (SEQ ID NO: 6595), SSVKXQP (SEQ ID NO: 6451):SRV:NAIS-AA17-LYF (SEQ ID NO: 6595), RNVQXRP (SEQ ID NO: 6448):TQV:NAIS-AA17-LYF (SEQ ID NO: 6595), KIPKAXX (SEQ ID NO: 6445):APT:SATS-AA17-LYY (SEQ ID NO: 6599), GIPEPXX (SEQ ID NO: 6440):APT:SATS-AA17-LYY (SEQ ID NO: 6599), SIPKAXX (SEQ ID NO: 6450):APT:SATS-AA17-LYY (SEQ ID NO: 6599), HVTKPTX (SEQ ID NO: 6443):APT:SATS-AA17-LYY (SEQ ID NO: 6599), YVPKPXX (SEQ ID NO: 6454):APT:SATS-AA17-LYY (SEQ ID NO: 6599), TVPKPXX (SEQ ID NO: 6453):APT:SATS-AA17-LYY (SEQ ID NO: 6599), KVGKAXX (SEQ ID NO: 6446):APT:SATS-AA17-LYY (SEQ ID NO: 6599), KASKAXX (SEQ ID NO: 6444):APT:SATS-AA17-LYY (SEQ ID NO: 6599), GSAGPXX (SEQ ID NO: 6441):APT:SATS-AA17-LYY (SEQ ID NO: 6599), AAPASXX (SEQ ID NO: 6436):APT:SATS-AA17-LYY (SEQ ID NO: 6599), STPPTXX (SEQ ID NO: 6452):APT:SATS-AA17-LYY (SEQ ID NO: 6599), HVPKPXX (SEQ ID NO: 6442):APT:SATS-AA17-LYY (SEQ ID NO: 6599), RVPSTXX (SEQ ID NO: 6449):APT:SATS-AA17-LYY (SEQ ID NO: 6599), ASAAPXX (SEQ ID NO: 6437):APT:SATS-AA17-LYY (SEQ ID NO: 6599), ASASPXX (SEQ ID NO: 6438):APT:SATS-AA17-LYY (SEQ ID NO: 6599), KIPKAXX (SEQ ID NO: 6445):VPT:SATS-AA17-LYY (SEQ ID NO: 6599), GIPEPXX (SEQ ID NO: 6440):VPE:SATS-AA17-LYY (SEQ ID NO: 6599), SIPKAXX (SEQ ID NO: 6450):VPT:SATS-AA17-LYY (SEQ ID NO: 6599), KVGKAXX (SEQ ID NO: 6446):VPT:SATS-AA17-LYY (SEQ ID NO: 6599), KASKAXX (SEQ ID NO: 6444):VPT:SATS-AA17-LYY (SEQ ID NO: 6599), GSAGPXX (SEQ ID NO: 6441):TPT:SATS-AA17-LYY (SEQ ID NO: 6599), AAPASXX (SEQ ID NO: 6436):VPA:SATS-AA17-LYY (SEQ ID NO: 6599), STPPTXX (SEQ ID NO: 6452):VPT:SATS-AA17-LYY (SEQ ID NO: 6599), RVPSTXX (SEQ ID NO: 6449):APV:SATS-AA17-LYY (SEQ ID NO: 6599), ASAAPXX (SEQ ID NO: 6437):VPQ:SATS-AA17-LYY (SEQ ID NO: 6599), ASASPXX (SEQ ID NO: 6438):VSQ:SATS-AA17-LYY (SEQ ID NO: 6599), ASASPXX (SEQ ID NO: 6438):VPQ:SATS-AA17-LYY (SEQ ID NO: 6599), NDEGLEX (SEQ ID NO: 6447):VPT:SATS-AA17-LYY (SEQ ID NO: 6599), SSVKXQP (SEQ ID NO: 6451):SRV:SATS-AA17-LYY (SEQ ID NO: 6599), RNVQXRP (SEQ ID NO: 6448):TQV:SATS-AA17-LYY (SEQ ID NO: 6599), KIPKAXX (SEQ ID NO: 6445):VPT:SPIS-AA17-LYK (SEQ ID NO: 6604), GIPEPXX (SEQ ID NO: 6440):VPT:SPIS-AA17-LYK (SEQ ID NO: 6604), SIPKAXX (SEQ ID NO: 6450):VPT:SPIS-AA17-LYK (SEQ ID NO: 6604), HVTKPTX (SEQ ID NO: 6443):VPT:SPIS-AA17-LYK (SEQ ID NO: 6604), YVPKPXX (SEQ ID NO: 6454):VPT:SPIS-AA17-LYK (SEQ ID NO: 6604), TVPKPXX (SEQ ID NO: 6453):VPT:SPIS-AA17-LYK (SEQ ID NO: 6604), AVPKAXX (SEQ ID NO: 6439):VPT:SPIS-AA17-LYK (SEQ ID NO: 6604), KASKAXX (SEQ ID NO: 6444):VPT:SPIS-AA17-LYK (SEQ ID NO: 6604), GSAGPXX (SEQ ID NO: 6441):VPT:SPIS-AA17-LYK (SEQ ID NO: 6604), AAPASXX (SEQ ID NO: 6436):VPT:SPIS-AA17-LYK (SEQ ID NO: 6604), STPPTXX (SEQ ID NO: 6452):VPT:SPIS-AA17-LYK (SEQ ID NO: 6604), HVPKPXX (SEQ ID NO: 6442):VPT:SPIS-AA17-LYK (SEQ ID NO: 6604), RVPSTXX (SEQ ID NO: 6449):VPT:SPIS-AA17-LYK (SEQ ID NO: 6604), ASAAPXX (SEQ ID NO: 6437):VPT:SPIS-AA17-LYK (SEQ ID NO: 6604), ASASPXX (SEQ ID NO: 6438):VPT:SPIS-AA17-LYK (SEQ ID NO: 6604), GIPEPXX (SEQ ID NO: 6440):VPE:SPIS-AA17-LYK (SEQ ID NO: 6604), HVTKPTX (SEQ ID NO: 6443):APT:SPIS-AA17-LYK (SEQ ID NO: 6604), YVPKPXX (SEQ ID NO: 6454):APT:SPIS-AA17-LYK (SEQ ID NO: 6604), TVPKPXX (SEQ ID NO: 6453):APT:SPIS-AA17-LYK (SEQ ID NO: 6604), AVPKAXX (SEQ ID NO: 6439):APT:SPIS-AA17-LYK (SEQ ID NO: 6604), GSAGPXX (SEQ ID NO: 6441):TPT:SPIS-AA17-LYK (SEQ ID NO: 6604), AAPASXX (SEQ ID NO: 6436):VPA:SPIS-AA17-LYK (SEQ ID NO: 6604), HVPKPXX (SEQ ID NO: 6442):APT:SPIS-AA17-LYK (SEQ ID NO: 6604), RVPSTXX (SEQ ID NO: 6449):APV:SPIS-AA17-LYK (SEQ ID NO: 6604), ASAAPXX (SEQ ID NO: 6437):VPQ:SPIS-AA17-LYK (SEQ ID NO: 6604), ASASPXX (SEQ ID NO: 6438):VSQ:SPIS-AA17-LYK (SEQ ID NO: 6604), ASASPXX (SEQ ID NO: 6438):VPQ:SPIS-AA17-LYK (SEQ ID NO: 6604), SSVKXQP (SEQ ID NO: 6451):SRV:SPIS-AA17-LYK (SEQ ID NO: 6604), RNVQXRP (SEQ ID NO: 6448):TQV:SPIS-AA17-LYK (SEQ ID NO: 6604), KIPKAXX (SEQ ID NO: 6445):VPT:EPIS-AA17-LYL (SEQ ID NO: 6591), GIPEPXX (SEQ ID NO: 6440):VPT:EPIS-AA17-LYL (SEQ ID NO: 6591), SIPKAXX (SEQ ID NO: 6450):VPT:EPIS-AA17-LYL (SEQ ID NO: 6591), HVTKPTX (SEQ ID NO: 6443):VPT:EPIS-AA17-LYL (SEQ ID NO: 6591), YVPKPXX (SEQ ID NO: 6454):VPT:EPIS-AA17-LYL (SEQ ID NO: 6591), TVPKPXX (SEQ ID NO: 6453):VPT:EPIS-AA17-LYL (SEQ ID NO: 6591), AVPKAXX (SEQ ID NO: 6439):VPT:EPIS-AA17-LYL (SEQ ID NO: 6591), KVGKAXX (SEQ ID NO: 6446):VPT:EPIS-AA17-LYL (SEQ ID NO: 6591), GSAGPXX (SEQ ID NO: 6441):VPT:EPIS-AA17-LYL (SEQ ID NO: 6591), AAPASXX (SEQ ID NO: 6436):VPT:EPIS-AA17-LYL (SEQ ID NO: 6591), STPPTXX (SEQ ID NO: 6452):VPT:EPIS-AA17-LYL (SEQ ID NO: 6591), HVPKPXX (SEQ ID NO: 6442):VPT:EPIS-AA17-LYL (SEQ ID NO: 6591), RVPSTXX (SEQ ID NO: 6449):VPT:EPIS-AA17-LYL (SEQ ID NO: 6591), ASAAPXX (SEQ ID NO: 6437):VPT:EPIS-AA17-LYL (SEQ ID NO: 6591), ASASPXX (SEQ ID NO: 6438):VPT:EPIS-AA17-LYL (SEQ ID NO: 6591), GIPEPXX (SEQ ID NO: 6440):VPE:EPIS-AA17-LYL (SEQ ID NO: 6591), HVTKPTX (SEQ ID NO: 6443):APT:EPIS-AA17-LYL (SEQ ID NO: 6591), YVPKPXX (SEQ ID NO: 6454):APT:EPIS-AA17-LYL (SEQ ID NO: 6591), TVPKPXX (SEQ ID NO: 6453):APT:EPIS-AA17-LYL (SEQ ID NO: 6591), AVPKAXX (SEQ ID NO: 6439):APT:EPIS-AA17-LYL (SEQ ID NO: 6591), GSAGPXX (SEQ ID NO: 6441):TPT:EPIS-AA17-LYL (SEQ ID NO: 6591), AAPASXX (SEQ ID NO: 6436):VPA:EPIS-AA17-LYL (SEQ ID NO: 6591), HVPKPXX (SEQ ID NO: 6442):APT:EPIS-AA17-LYL (SEQ ID NO: 6591), RVPSTXX (SEQ ID NO: 6449):APV:EPIS-AA17-LYL (SEQ ID NO: 6591), ASAAPXX (SEQ ID NO: 6437):VPQ:EPIS-AA17-LYL (SEQ ID NO: 6591), ASASPXX (SEQ ID NO: 6438):VSQ:EPIS-AA17-LYL (SEQ ID NO: 6591), ASASPXX (SEQ ID NO: 6438):VPQ:EPIS-AA17-LYL (SEQ ID NO: 6591), SSVKXQP (SEQ ID NO: 6451):SRV:EPIS-AA17-LYL (SEQ ID NO: 6591), RNVQXRP (SEQ ID NO: 6448):TQV:EPIS-AA17-LYL (SEQ ID NO: 6591), KIPKAXX (SEQ ID NO: 6445):TPT:SPIN-AA17-LYF (SEQ ID NO: 6601), GIPEPXX (SEQ ID NO: 6440):TPT:SPIN-AA17-LYF (SEQ ID NO: 6601), SIPKAXX (SEQ ID NO: 6450):TPT:SPIN-AA17-LYF (SEQ ID NO: 6601), HVTKPTX (SEQ ID NO: 6443):TPT:SPIN-AA17-LYF (SEQ ID NO: 6601), YVPKPXX (SEQ ID NO: 6454):TPT:SPIN-AA17-LYF (SEQ ID NO: 6601), TVPKPXX (SEQ ID NO: 6453):TPT:SPIN-AA17-LYF (SEQ ID NO: 6601), AVPKAXX (SEQ ID NO: 6439):TPT:SPIN-AA17-LYF (SEQ ID NO: 6601), KVGKAXX (SEQ ID NO: 6446):TPT:SPIN-AA17-LYF (SEQ ID NO: 6601), KASKAXX (SEQ ID NO: 6444):TPT:SPIN-AA17-LYF (SEQ ID NO: 6601), AAPASXX (SEQ ID NO: 6436):TPT:SPIN-AA17-LYF (SEQ ID NO: 6601), STPPTXX (SEQ ID NO: 6452):TPT:SPIN-AA17-LYF (SEQ ID NO: 6601), HVPKPXX (SEQ ID NO: 6442):TPT:SPIN-AA17-LYF (SEQ ID NO: 6601), RVPSTXX (SEQ ID NO: 6449):TPT:SPIN-AA17-LYF (SEQ ID NO: 6601), ASAAPXX (SEQ ID NO: 6437):TPT:SPIN-AA17-LYF (SEQ ID NO: 6601), ASASPXX (SEQ ID NO: 6438):TPT:SPIN-AA17-LYF (SEQ ID NO: 6601), KIPKAXX (SEQ ID NO: 6445):VPT:SPIN-AA17-LYF (SEQ ID NO: 6601), GIPEPXX (SEQ ID NO: 6440):VPE:SPIN-AA17-LYF (SEQ ID NO: 6601), SIPKAXX (SEQ ID NO: 6450):VPT:SPIN-AA17-LYF (SEQ ID NO: 6601), HVTKPTX (SEQ ID NO: 6443):APT:SPIN-AA17-LYF (SEQ ID NO: 6601), YVPKPXX (SEQ ID NO: 6454):APT:SPIN-AA17-LYF (SEQ ID NO: 6601), TVPKPXX (SEQ ID NO: 6453):APT:SPIN-AA17-LYF (SEQ ID NO: 6601), AVPKAXX (SEQ ID NO: 6439):APT:SPIN-AA17-LYF (SEQ ID NO: 6601), KVGKAXX (SEQ ID NO: 6446):VPT:SPIN-AA17-LYF (SEQ ID NO: 6601), KASKAXX (SEQ ID NO: 6444):VPT:SPIN-AA17-LYF (SEQ ID NO: 6601), AAPASXX (SEQ ID NO: 6436):VPA:SPIN-AA17-LYF (SEQ ID NO: 6601), STPPTXX (SEQ ID NO: 6452):VPT:SPIN-AA17-LYF (SEQ ID NO: 6601), HVPKPXX (SEQ ID NO: 6442):APT:SPIN-AA17-LYF (SEQ ID NO: 6601), RVPSTXX (SEQ ID NO: 6449):APV:SPIN-AA17-LYF (SEQ ID NO: 6601), ASAAPXX (SEQ ID NO: 6437):VPQ:SPIN-AA17-LYF (SEQ ID NO: 6601), ASASPXX (SEQ ID NO: 6438):VSQ:SPIN-AA17-LYF (SEQ ID NO: 6601), ASASPXX (SEQ ID NO: 6438):VPQ:SPIN-AA17-LYF (SEQ ID NO: 6601), NDEGLEX (SEQ ID NO: 6447):VPT:SPIN-AA17-LYF (SEQ ID NO: 6601), SSVKXQP (SEQ ID NO: 6451):SRV: SPIN-AA17-LYF (SEQ ID NO: 6601), RNVQXRP (SEQ ID NO: 6448):TQV:SPIN-AA17-LYF (SEQ ID NO: 6601), KIPKAXX (SEQ ID NO: 6445):VPA:SPIS-AA17-LYI (SEQ ID NO: 6603), GIPEPXX (SEQ ID NO: 6440):VPA: SPIS-AA17-LYI (SEQ ID NO: 6603), SIPKAXX (SEQ ID NO: 6450):VPA:SPIS-AA17-LYI (SEQ ID NO: 6603), HVTKPTX (SEQ ID NO: 6443):VPA:SPIS-AA17-LYI (SEQ ID NO: 6603), YVPKPXX (SEQ ID NO: 6454):VPA: SPIS-AA17-LYI (SEQ ID NO: 6603), TVPKPXX (SEQ ID NO: 6453):VPA:SPIS-AA17-LYI (SEQ ID NO: 6603), AVPKAXX (SEQ ID NO: 6439):VPA:SPIS-AA17-LYI (SEQ ID NO: 6603), KVGKAXX (SEQ ID NO: 6446): VPA:SPIS-AA17-LYI (SEQ ID NO: 6603), KASKAXX (SEQ ID NO: 6444):VPA:SPIS-AA17-LYI (SEQ ID NO: 6603), GSAGPXX (SEQ ID NO: 6441):VPA:SPIS-AA17-LYI (SEQ ID NO: 6603), STPPTXX (SEQ ID NO: 6452): VPA:SPIS-AA17-LYI (SEQ ID NO: 6603), HVPKPXX (SEQ ID NO: 6442):VPA:SPIS-AA17-LYI (SEQ ID NO: 6603), RVPSTXX (SEQ ID NO: 6449):VPA:SPIS-AA17-LYI (SEQ ID NO: 6603), ASAAPXX (SEQ ID NO: 6437): VPA:SPIS-AA17-LYI (SEQ ID NO: 6603), ASASPXX (SEQ ID NO: 6438):VPA:SPIS-AA17-LYI (SEQ ID NO: 6603), KIPKAXX (SEQ ID NO: 6445):VPT:SPIS-AA17-LYI (SEQ ID NO: 6603), GIPEPXX (SEQ ID NO: 6440): VPE:SPIS-AA17-LYI (SEQ ID NO: 6603), SIPKAXX (SEQ ID NO: 6450):VPT:SPIS-AA17-LYI (SEQ ID NO: 6603), HVTKPTX (SEQ ID NO: 6443):APT:SPIS-AA17-LYI (SEQ ID NO: 6603), YVPKPXX (SEQ ID NO: 6454): APT:SPIS-AA17-LYI (SEQ ID NO: 6603), TVPKPXX (SEQ ID NO: 6453):APT:SPIS-AA17-LYI (SEQ ID NO: 6603), AVPKAXX (SEQ ID NO: 6439):APT:SPIS-AA17-LYI (SEQ ID NO: 6603), KVGKAXX (SEQ ID NO: 6446): VPT:SPIS-AA17-LYI (SEQ ID NO: 6603), KASKAXX (SEQ ID NO: 6444):VPT:SPIS-AA17-LYI (SEQ ID NO: 6603), GSAGPXX (SEQ ID NO: 6441):TPT:SPIS-AA17-LYI (SEQ ID NO: 6603), STPPTXX (SEQ ID NO: 6452): VPT:SPIS-AA17-LYI (SEQ ID NO: 6603), HVPKPXX (SEQ ID NO: 6442):APT:SPIS-AA17-LYI (SEQ ID NO: 6603), RVPSTXX (SEQ ID NO: 6449):APV:SPIS-AA17-LYI (SEQ ID NO: 6603), ASAAPXX (SEQ ID NO: 6437): VPQ:SPIS-AA17-LYI (SEQ ID NO: 6603), ASASPXX (SEQ ID NO: 6438):VSQ:SPIS-AA17-LYI (SEQ ID NO: 6603), ASASPXX (SEQ ID NO: 6438):VPQ:SPIS-AA17-LYI (SEQ ID NO: 6603), NDEGLEX (SEQ ID NO: 6447): VPT:SPIS-AA17-LYI (SEQ ID NO: 6603), SSVKXQP (SEQ ID NO: 6451):SRV:SPIS-AA17-LYI (SEQ ID NO: 6603), RNVQXRP (SEQ ID NO: 6448):TQV:SPIS-AA17-LYI (SEQ ID NO: 6603), KIPKAXX (SEQ ID NO: 6445): VPT:SPIS-AA17-LFI (SEQ ID NO: 6602), GIPEPXX (SEQ ID NO: 6440):VPT:SPIS-AA17-LFI (SEQ ID NO: 6602), SIPKAXX (SEQ ID NO: 6450):VPT:SPIS-AA17-LFI (SEQ ID NO: 6602), HVTKPTX (SEQ ID NO: 6443):VPT:SPIS-AA17-LFI (SEQ ID NO: 6602), YVPKPXX (SEQ ID NO: 6454):VPT:SPIS-AA17-LFI (SEQ ID NO: 6602), TVPKPXX (SEQ ID NO: 6453):VPT:SPIS-AA17-LFI (SEQ ID NO: 6602), AVPKAXX (SEQ ID NO: 6439):VPT: SPIS-AA17-LFI (SEQ ID NO: 6602), KVGKAXX (SEQ ID NO: 6446):VPT:SPIS-AA17-LFI (SEQ ID NO: 6602), KASKAXX (SEQ ID NO: 6444):VPT:SPIS-AA17-LFI (SEQ ID NO: 6602), GSAGPXX (SEQ ID NO: 6441):VPT: SPIS-AA17-LFI (SEQ ID NO: 6602), AAPASXX (SEQ ID NO: 6436):VPT:SPIS-AA17-LFI (SEQ ID NO: 6602), HVPKPXX (SEQ ID NO: 6442):VPT:SPIS-AA17-LFI (SEQ ID NO: 6602), RVPSTXX (SEQ ID NO: 6449):VPT: SPIS-AA17-LFI (SEQ ID NO: 6602), ASAAPXX (SEQ ID NO: 6437):VPT:SPIS-AA17-LFI (SEQ ID NO: 6602), ASASPXX (SEQ ID NO: 6438):VPT:SPIS-AA17-LFI (SEQ ID NO: 6602), GIPEPXX (SEQ ID NO: 6440):VPE: SPIS-AA17-LFI (SEQ ID NO: 6602), HVTKPTX (SEQ ID NO: 6443):APT:SPIS-AA17-LFI (SEQ ID NO: 6602), YVPKPXX (SEQ ID NO: 6454):APT:SPIS-AA17-LFI (SEQ ID NO: 6602), TVPKPXX (SEQ ID NO: 6453):APT: SPIS-AA17-LFI (SEQ ID NO: 6602), AVPKAXX (SEQ ID NO: 6439):APT:SPIS-AA17-LFI (SEQ ID NO: 6602), GSAGPXX (SEQ ID NO: 6441):TPT:SPIS-AA17-LFI (SEQ ID NO: 6602), AAPASXX (SEQ ID NO: 6436):VPA: SPIS-AA17-LFI (SEQ ID NO: 6602), HVPKPXX (SEQ ID NO: 6442):APT:SPIS-AA17-LFI (SEQ ID NO: 6602), RVPSTXX (SEQ ID NO: 6449):APV:SPIS-AA17-LFI (SEQ ID NO: 6602), ASAAPXX (SEQ ID NO: 6437):VPQ: SPIS-AA17-LFI (SEQ ID NO: 6602), ASASPXX (SEQ ID NO: 6438):VSQ:SPIS-AA17-LFI (SEQ ID NO: 6602), ASASPXX (SEQ ID NO: 6438):VPQ:SPIS-AA17-LFI (SEQ ID NO: 6602), SSVKXQP (SEQ ID NO: 6451):SRV: SPIS-AA17-LFI (SEQ ID NO: 6602), RNVQXRP (SEQ ID NO: 6448):TQV:SPIS-AA17-LFI (SEQ ID NO: 6602), KIPKAXX (SEQ ID NO: 6445):APV:KPLS-AA17-LYV (SEQ ID NO: 6594), GIPEPXX (SEQ ID NO: 6440):APV: KPLS-AA17-LYV (SEQ ID NO: 6594), SIPKAXX (SEQ ID NO: 6450):APV:KPLS-AA17-LYV (SEQ ID NO: 6594), HVTKPTX (SEQ ID NO: 6443):APV:KPLS-AA17-LYV (SEQ ID NO: 6594), YVPKPXX (SEQ ID NO: 6454):APV: KPLS-AA17-LYV (SEQ ID NO: 6594), TVPKPXX (SEQ ID NO: 6453):APV:KPLS-AA17-LYV (SEQ ID NO: 6594), AVPKAXX (SEQ ID NO: 6439):APV:KPLS-AA17-LYV (SEQ ID NO: 6594), KVGKAXX (SEQ ID NO: 6446): APV:KPLS-AA17-LYV (SEQ ID NO: 6594), KASKAXX (SEQ ID NO: 6444):APV:KPLS-AA17-LYV (SEQ ID NO: 6594), GSAGPXX (SEQ ID NO: 6441):APV:KPLS-AA17-LYV (SEQ ID NO: 6594), AAPASXX (SEQ ID NO: 6436): APV:KPLS-AA17-LYV (SEQ ID NO: 6594), STPPTXX (SEQ ID NO: 6452):APV:KPLS-AA17-LYV (SEQ ID NO: 6594), HVPKPXX (SEQ ID NO: 6442):APV:KPLS-AA17-LYV (SEQ ID NO: 6594), ASAAPXX (SEQ ID NO: 6437): APV:KPLS-AA17-LYV (SEQ ID NO: 6594), ASASPXX (SEQ ID NO: 6438):APV:KPLS-AA17-LYV (SEQ ID NO: 6594), KIPKAXX (SEQ ID NO: 6445):VPT:KPLS-AA17-LYV (SEQ ID NO: 6594), GIPEPXX (SEQ ID NO: 6440): VPE:KPLS-AA17-LYV (SEQ ID NO: 6594), SIPKAXX (SEQ ID NO: 6450):VPT:KPLS-AA17-LYV (SEQ ID NO: 6594), HVTKPTX (SEQ ID NO: 6443):APT:KPLS-AA17-LYV (SEQ ID NO: 6594), YVPKPXX (SEQ ID NO: 6454): APT:KPLS-AA17-LYV (SEQ ID NO: 6594), TVPKPXX (SEQ ID NO: 6453):APT:KPLS-AA17-LYV (SEQ ID NO: 6594), AVPKAXX (SEQ ID NO: 6439):APT:KPLS-AA17-LYV (SEQ ID NO: 6594), KVGKAXX (SEQ ID NO: 6446):VPT:KPLS-AA17-LYV (SEQ ID NO: 6594), KASKAXX (SEQ ID NO: 6444):VPT:KPLS-AA17-LYV (SEQ ID NO: 6594), GSAGPXX (SEQ ID NO: 6441):TPT: KPLS-AA17-LYV (SEQ ID NO: 6594), AAPASXX (SEQ ID NO: 6436):VPA:KPLS-AA17-LYV (SEQ ID NO: 6594), STPPTXX (SEQ ID NO: 6452):VPT:KPLS-AA17-LYV (SEQ ID NO: 6594), HVPKPXX (SEQ ID NO: 6442):APT: KPLS-AA17-LYV (SEQ ID NO: 6594), ASAAPXX (SEQ ID NO: 6437):VPQ:KPLS-AA17-LYV (SEQ ID NO: 6594), ASASPXX (SEQ ID NO: 6438):VSQ:KPLS-AA17-LYV (SEQ ID NO: 6594), ASASPXX (SEQ ID NO: 6438):VPQ: KPLS-AA17-LYV (SEQ ID NO: 6594), NDEGLEX (SEQ ID NO: 6447):VPT:KPLS-AA17-LYV (SEQ ID NO: 6594), SSVKXQP (SEQ ID NO: 6451):SRV:KPLS-AA17-LYV (SEQ ID NO: 6594), RNVQXRP (SEQ ID NO: 6448):TQV:

KPLS-AA17-LYV (SEQ ID NO: 6594), KIPKAXX (SEQ ID NO: 6445):VPQ:EPLP-AA17-VYY (SEQ ID NO: 6592), GIPEPXX (SEQ ID NO: 6440):VPQ:EPLP-AA17-VYY (SEQ ID NO: 6592), SIPKAXX (SEQ ID NO: 6450):VPQ:EPLP-AA17-VYY (SEQ ID NO: 6592), HVTKPTX (SEQ ID NO: 6443):VPQ:EPLP-AA17-VYY (SEQ ID NO: 6592), YVPKPXX (SEQ ID NO: 6454):VPQ:EPLP-AA17-VYY (SEQ ID NO: 6592), TVPKPXX (SEQ ID NO: 6453):VPQ:EPLP-AA17-VYY (SEQ ID NO: 6592), AVPKAXX (SEQ ID NO: 6439):VPQ:EPLP-AA17-VYY (SEQ ID NO: 6592), KVGKAXX (SEQ ID NO: 6446):VPQ:EPLP-AA17-VYY (SEQ ID NO: 6592), KASKAXX (SEQ ID NO: 6444):VPQ:EPLP-AA17-VYY (SEQ ID NO: 6592), GSAGPXX (SEQ ID NO: 6441):VPQ:EPLP-AA17-VYY (SEQ ID NO: 6592), AAPASXX (SEQ ID NO: 6436):VPQ:EPLP-AA17-VYY (SEQ ID NO: 6592), STPPTXX (SEQ ID NO: 6452):VPQ:EPLP-AA17-VYY (SEQ ID NO: 6592), HVPKPXX (SEQ ID NO: 6442):VPQ:EPLP-AA17-VYY (SEQ ID NO: 6592), RVPSTXX (SEQ ID NO: 6449):VPQ:EPLP-AA17-VYY (SEQ ID NO: 6592), ASASPXX (SEQ ID NO: 6438):VPQ:EPLP-AA17-VYY (SEQ ID NO: 6592), KIPKAXX (SEQ ID NO: 6445):VPT:EPLP-AA17-VYY (SEQ ID NO: 6592), GIPEPXX (SEQ ID NO: 6440):VPE:EPLP-AA17-VYY (SEQ ID NO: 6592), SIPKAXX (SEQ ID NO: 6450):VPT:EPLP-AA17-VYY (SEQ ID NO: 6592), HVTKPTX (SEQ ID NO: 6443):APT:EPLP-AA17-VYY (SEQ ID NO: 6592), YVPKPXX (SEQ ID NO: 6454):APT:EPLP-AA17-VYY (SEQ ID NO: 6592), TVPKPXX (SEQ ID NO: 6453):APT:EPLP-AA17-VYY (SEQ ID NO: 6592), AVPKAXX (SEQ ID NO: 6439):APT:EPLP-AA17-VYY (SEQ ID NO: 6592), KVGKAXX (SEQ ID NO: 6446):VPT:EPLP-AA17-VYY (SEQ ID NO: 6592), KASKAXX (SEQ ID NO: 6444):VPT:EPLP-AA17-VYY (SEQ ID NO: 6592), GSAGPXX (SEQ ID NO: 6441):TPT:EPLP-AA17-VYY (SEQ ID NO: 6592), AAPASXX (SEQ ID NO: 6436):VPA:EPLP-AA17-VYY (SEQ ID NO: 6592), STPPTXX (SEQ ID NO: 6452):VPT:EPLP-AA17-VYY (SEQ ID NO: 6592), HVPKPXX (SEQ ID NO: 6442):APT:EPLP-AA17-VYY (SEQ ID NO: 6592), RVPSTXX (SEQ ID NO: 6449):APV:EPLP-AA17-VYY (SEQ ID NO: 6592), ASASPXX (SEQ ID NO: 6438):VSQ:EPLP-AA17-VYY (SEQ ID NO: 6592), NDEGLEX (SEQ ID NO: 6447):VPT:EPLP-AA17-VYY (SEQ ID NO: 6592), SSVKXQP (SEQ ID NO: 6451):SRV:EPLP-AA17-VYY (SEQ ID NO: 6592), RNVQXRP (SEQ ID NO: 6448):TQV:EPLP-AA17-VYY (SEQ ID NO: 6592), KIPKAXX (SEQ ID NO: 6445):VSQ:EPLT-AA17-LYY (SEQ ID NO: 6593), GIPEPXX (SEQ ID NO: 6440):VSQ:EPLT-AA17-LYY (SEQ ID NO: 6593), SIPKAXX (SEQ ID NO: 6450):VSQ:EPLT-AA17-LYY (SEQ ID NO: 6593), HVTKPTX (SEQ ID NO: 6443):VSQ:EPLT-AA17-LYY (SEQ ID NO: 6593), YVPKPXX (SEQ ID NO: 6454):VSQ:EPLT-AA17-LYY (SEQ ID NO: 6593), TVPKPXX (SEQ ID NO: 6453):VSQ: EPLT-AA17-LYY (SEQ ID NO: 6593), AVPKAXX (SEQ ID NO: 6439):VSQ:EPLT-AA17-LYY (SEQ ID NO: 6593), KVGKAXX (SEQ ID NO: 6446):VSQ:EPLT-AA17-LYY (SEQ ID NO: 6593), KASKAXX (SEQ ID NO: 6444):VSQ: EPLT-AA17-LYY (SEQ ID NO: 6593), GSAGPXX (SEQ ID NO: 6441):VSQ:EPLT-AA17-LYY (SEQ ID NO: 6593), AAPASXX (SEQ ID NO: 6436):VSQ:EPLT-AA17-LYY (SEQ ID NO: 6593), STPPTXX (SEQ ID NO: 6452):VSQ: EPLT-AA17-LYY (SEQ ID NO: 6593), HVPKPXX (SEQ ID NO: 6442):VSQ:EPLT-AA17-LYY (SEQ ID NO: 6593), RVPSTXX (SEQ ID NO: 6449):VSQ:EPLT-AA17-LYY (SEQ ID NO: 6593), ASAAPXX (SEQ ID NO: 6437):VSQ: EPLT-AA17-LYY (SEQ ID NO: 6593), ASASPXX (SEQ ID NO: 6438):VSQ:EPLT-AA17-LYY (SEQ ID NO: 6593), KIPKAXX (SEQ ID NO: 6445):VPT:EPLT-AA17-LYY (SEQ ID NO: 6593), GIPEPXX (SEQ ID NO: 6440):VPE: EPLT-AA17-LYY (SEQ ID NO: 6593), SIPKAXX (SEQ ID NO: 6450):VPT:EPLT-AA17-LYY (SEQ ID NO: 6593), HVTKPTX (SEQ ID NO: 6443):APT:EPLT-AA17-LYY (SEQ ID NO: 6593), YVPKPXX (SEQ ID NO: 6454):APT: EPLT-AA17-LYY (SEQ ID NO: 6593), TVPKPXX (SEQ ID NO: 6453):APT:EPLT-AA17-LYY (SEQ ID NO: 6593), AVPKAXX (SEQ ID NO: 6439):APT:EPLT-AA17-LYY (SEQ ID NO: 6593), KVGKAXX (SEQ ID NO: 6446):VPT: EPLT-AA17-LYY (SEQ ID NO: 6593), KASKAXX (SEQ ID NO: 6444):VPT:EPLT-AA17-LYY (SEQ ID NO: 6593), GSAGPXX (SEQ ID NO: 6441):TPT:EPLT-AA17-LYY (SEQ ID NO: 6593), AAPASXX (SEQ ID NO: 6436):VPA: EPLT-AA17-LYY (SEQ ID NO: 6593), STPPTXX (SEQ ID NO: 6452):VPT:EPLT-AA17-LYY (SEQ ID NO: 6593), HVPKPXX (SEQ ID NO: 6442):APT:EPLT-AA17-LYY (SEQ ID NO: 6593), RVPSTXX (SEQ ID NO: 6449):APV: EPLT-AA17-LYY (SEQ ID NO: 6593), ASAAPXX (SEQ ID NO: 6437):VPQ:EPLT-AA17-LYY (SEQ ID NO: 6593), NDEGLEX (SEQ ID NO: 6447):VPT:EPLT-AA17-LYY (SEQ ID NO: 6593), SSVKXQP (SEQ ID NO: 6451):SRV: EPLT-AA17-LYY (SEQ ID NO: 6593), RNVQXRP (SEQ ID NO: 6448):TQV:EPLT-AA17-LYY (SEQ ID NO: 6593), KIPKAXX (SEQ ID NO: 6445):VPQ:EPLT-AA17-LYY (SEQ ID NO: 6593), GIPEPXX (SEQ ID NO: 6440):VPQ: EPLT-AA17-LYY (SEQ ID NO: 6593), SIPKAXX (SEQ ID NO: 6450):VPQ:EPLT-AA17-LYY (SEQ ID NO: 6593), HVTKPTX (SEQ ID NO: 6443):VPQ:EPLT-AA17-LYY (SEQ ID NO: 6593), YVPKPXX (SEQ ID NO: 6454):VPQ: EPLT-AA17-LYY (SEQ ID NO: 6593), TVPKPXX (SEQ ID NO: 6453):VPQ:EPLT-AA17-LYY (SEQ ID NO: 6593), AVPKAXX (SEQ ID NO: 6439):VPQ:EPLT-AA17-LYY (SEQ ID NO: 6593), KVGKAXX (SEQ ID NO: 6446): VPQ:EPLT-AA17-LYY (SEQ ID NO: 6593), KASKAXX (SEQ ID NO: 6444):VPQ:EPLT-AA17-LYY (SEQ ID NO: 6593), GSAGPXX (SEQ ID NO: 6441):VPQ:EPLT-AA17-LYY (SEQ ID NO: 6593), AAPASXX (SEQ ID NO: 6436): VPQ:EPLT-AA17-LYY (SEQ ID NO: 6593), STPPTXX (SEQ ID NO: 6452):VPQ:EPLT-AA17-LYY (SEQ ID NO: 6593), HVPKPXX (SEQ ID NO: 6442):VPQ:EPLT-AA17-LYY (SEQ ID NO: 6593), RVPSTXX (SEQ ID NO: 6449): VPQ:EPLT-AA17-LYY (SEQ ID NO: 6593), ASASPXX (SEQ ID NO: 6438):VPQ:EPLT-AA17-LYY (SEQ ID NO: 6593), NDEGLEX (SEQ ID NO: 6447):VPT:SNIT-AA17-QIM (SEQ ID NO: 6600), GIPEPXX (SEQ ID NO: 6440): VPE:SNIT-AA17-QIM (SEQ ID NO: 6600), HVTKPTX (SEQ ID NO: 6443):APT:SNIT-AA17-QIM (SEQ ID NO: 6600), YVPKPXX (SEQ ID NO: 6454):APT:SNIT-AA17-QIM (SEQ ID NO: 6600), TVPKPXX (SEQ ID NO: 6453): APT:SNIT-AA17-QIM (SEQ ID NO: 6600), AVPKAXX (SEQ ID NO: 6439):APT:SNIT-AA17-QIM (SEQ ID NO: 6600), GSAGPXX (SEQ ID NO: 6441):TPT:SNIT-AA17-QIM (SEQ ID NO: 6600), AAPASXX (SEQ ID NO: 6436): VPA:SNIT-AA17-QIM (SEQ ID NO: 6600), HVPKPXX (SEQ ID NO: 6442):APT:SNIT-AA17-QIM (SEQ ID NO: 6600), RVPSTXX (SEQ ID NO: 6449):APV:SNIT-AA17-QIM (SEQ ID NO: 6600), ASAAPXX (SEQ ID NO: 6437): VPQ:SNIT-AA17-QIM (SEQ ID NO: 6600), ASASPXX (SEQ ID NO: 6438):VSQ:SNIT-AA17-QIM (SEQ ID NO: 6600), ASASPXX (SEQ ID NO: 6438):VPQ:SNIT-AA17-QIM (SEQ ID NO: 6600), SSVKXQP (SEQ ID NO: 6451): SRV:SNIT-AA17-QIM (SEQ ID NO: 6600), RNVQXRP (SEQ ID NO: 6448):TQV:SNIT-AA17-QIM (SEQ ID NO: 6600), RNVQXRP (SEQ ID NO: 6448):SRV:RSVK-AA17-AKV (SEQ ID NO: 6597), KIPKAXX (SEQ ID NO: 6445):VPT:RSVK-AA17-AKV (SEQ ID NO: 6597),

GIPEPXX (SEQ ID NO: 6440):VPE:RSVK-AA17-AKV (SEQ ID NO: 6597), SIPKAXX (SEQ ID NO: 6450):VPT:RSVK-AA17-AKV (SEQ ID NO: 6597), HVTKPTX (SEQ ID NO: 6443):APT:RSVK-AA17-AKV (SEQ ID NO: 6597), YVPKPXX (SEQ ID NO: 6454):APT:RSVK-AA17-AKV (SEQ ID NO: 6597), TVPKPXX (SEQ ID NO: 6453):APT:RSVK-AA17-AKV (SEQ ID NO: 6597), AVPKAXX (SEQ ID NO: 6439):APT:RSVK-AA17-AKV (SEQ ID NO: 6597), KVGKAXX (SEQ ID NO: 6446):VPT:RSVK-AA17-AKV (SEQ ID NO: 6597), KASKAXX (SEQ ID NO: 6444):VPT:RSVK-AA17-AKV (SEQ ID NO: 6597), GSAGPXX (SEQ ID NO: 6441):TPT:RSVK-AA17-AKV (SEQ ID NO: 6597), AAPASXX (SEQ ID NO: 6436):VPA:RSVK-AA17-AKV (SEQ ID NO: 6597), STPPTXX (SEQ ID NO: 6452):VPT:RSVK-AA17-AKV (SEQ ID NO: 6597), HVPKPXX (SEQ ID NO: 6442):APT:RSVK-AA17-AKV (SEQ ID NO: 6597), RVPSTXX (SEQ ID NO: 6449):APV:RSVK-AA17-AKV (SEQ ID NO: 6597), ASAAPXX (SEQ ID NO: 6437):VPQ:RSVK-AA17-AKV (SEQ ID NO: 6597), ASASPXX (SEQ ID NO: 6438):VSQ:RSVK-AA17-AKV (SEQ ID NO: 6597), ASASPXX (SEQ ID NO: 6438):VPQ:RSVK-AA17-AKV (SEQ ID NO: 6597), NDEGLEX (SEQ ID NO: 6447):VPT:RSVK-AA17-AKV (SEQ ID NO: 6597), RNVQXRP (SEQ ID NO: 6448):TQV:RSVK-AA17-AKV (SEQ ID NO: 6597), SSVKXQP (SEQ ID NO: 6451):TQV:RPVQ-AA17-RKI (SEQ ID NO: 6596), KIPKAXX (SEQ ID NO: 6445):VPT:RPVQ-AA17-RKI (SEQ ID NO: 6596), GIPEPXX (SEQ ID NO: 6440):VPE:RPVQ-AA17-RKI (SEQ ID NO: 6596), SIPKAXX (SEQ ID NO: 6450):VPT:RPVQ-AA17-RKI (SEQ ID NO: 6596), HVTKPTX (SEQ ID NO: 6443):APT:RPVQ-AA17-RKI (SEQ ID NO: 6596), YVPKPXX (SEQ ID NO: 6454):APT:RPVQ-AA17-RKI (SEQ ID NO: 6596), TVPKPXX (SEQ ID NO: 6453):APT:RPVQ-AA17-RKI (SEQ ID NO: 6596), AVPKAXX (SEQ ID NO: 6439):APT:RPVQ-AA17-RKI (SEQ ID NO: 6596), KVGKAXX (SEQ ID NO: 6446):VPT:RPVQ-AA17-RKI (SEQ ID NO: 6596), KASKAXX (SEQ ID NO: 6444):VPT:RPVQ-AA17-RKI (SEQ ID NO: 6596), GSAGPXX (SEQ ID NO: 6441):TPT:RPVQ-AA17-RKI (SEQ ID NO: 6596), AAPASXX (SEQ ID NO: 6436):VPA:RPVQ-AA17-RKI (SEQ ID NO: 6596), STPPTXX (SEQ ID NO: 6452):VPT:RPVQ-AA17-RKI (SEQ ID NO: 6596), HVPKPXX (SEQ ID NO: 6442):APT:RPVQ-AA17-RKI (SEQ ID NO: 6596), RVPSTXX (SEQ ID NO: 6449):APV:RPVQ-AA17-RKI (SEQ ID NO: 6596), ASAAPXX (SEQ ID NO: 6437):VPQ:RPVQ-AA17-RKI (SEQ ID NO: 6596), ASASPXX (SEQ ID NO: 6438):VSQ:RPVQ-AA17-RKI (SEQ ID NO: 6596), ASASPXX (SEQ ID NO: 6438):VPQ:RPVQ-AA17-RKI (SEQ ID NO: 6596), NDEGLEX (SEQ ID NO: 6447):VPT:RPVQ-AA17-RKI (SEQ ID NO: 6596) and SSVKXQP (SEQ ID NO: 6451):SRV:RPVQ-AA17-RKI (SEQ ID NO: 6596); and wherein $AA^{17}$ is selected from the group consisting of G, A, V, L, I, P, F, M, W, T and S (in particular is selected from the group consisting of M, I, L, V and T).

In certain embodiments, the triplet PEP7:PEP5:PEP1 is selected from the group consisting of GIPEPXX (SEQ ID NO: 6440):VPTKM (SEQ ID NO: 6424):SAIS (SEQ ID NO: 6360), HVTKPTX (SEQ ID NO: 6443):VPTKL (SEQ ID NO: 6423):SAIS (SEQ ID NO: 6360), YVPKPXX (SEQ ID NO: 6454):VPTKL (SEQ ID NO: 6423):SAIS (SEQ ID NO: 6360), TVPKPXX (SEQ ID NO: 6453):VPTQL (SEQ ID NO: 6426):SAIS (SEQ ID NO: 6360), AVPKAXX (SEQ ID NO: 6439):VPTKL (SEQ ID NO: 6423):SAIS (SEQ ID NO: 6360), KVGKAXX (SEQ ID NO: 6446):VPTKL (SEQ ID NO: 6423):SAIS (SEQ ID NO: 6360), KASKAXX (SEQ ID NO: 6444):VPTKL (SEQ ID NO: 6423):SAIS (SEQ ID NO: 6360), GSAGPXX (SEQ ID NO: 6441):VPTKM (SEQ ID NO: 6424):SAIS (SEQ ID NO: 6360), AAPASXX (SEQ ID NO: 6436):VPTRL (SEQ ID NO: 6427):SAIS (SEQ ID NO: 6360), STPPTXX (SEQ ID NO: 6452):VPTRL (SEQ ID NO: 6427):SAIS (SEQ ID NO: 6360), HVPKPXX (SEQ ID NO: 6442):VPTKL (SEQ ID NO: 6423):SAIS (SEQ ID NO: 6360), RVPSTXX (SEQ ID NO: 6449):VPTKT (SEQ ID NO: 6425):SAIS (SEQ ID NO: 6360), ASAAPXX (SEQ ID NO: 6437):VPTAL (SEQ ID NO: 6418):SAIS (SEQ ID NO: 6360), ASASPXX (SEQ ID NO: 6438):VPTDL (SEQ ID NO: 6419):SAIS (SEQ ID NO: 6360), GIPEPXX (SEQ ID NO: 6440):VPEKM (SEQ ID NO: 6406):SAIS (SEQ ID NO: 6360), HVTKPTX (SEQ ID NO: 6443):APTKL (SEQ ID NO: 6369):SAIS (SEQ ID NO: 6360), YVPKPXX (SEQ ID NO: 6454):APTKL (SEQ ID NO: 6369):SAIS (SEQ ID NO: 6360), TVPKPXX (SEQ ID NO: 6453):APTQL (SEQ ID NO: 6372):SAIS (SEQ ID NO: 6360), AVPKAXX (SEQ ID NO: 6439):APTKL (SEQ ID NO: 6369):SAIS (SEQ ID NO: 6360), GSAGPXX (SEQ ID NO: 6441):TPTKM (SEQ ID NO: 6388):SAIS (SEQ ID NO: 6360), AAPASXX (SEQ ID NO: 6436):VPARL (SEQ ID NO: 6401):SAIS (SEQ ID NO: 6360), HVPKPXX (SEQ ID NO: 6442):APTKL (SEQ ID NO: 6369):SAIS (SEQ ID NO: 6360), RVPSTXX (SEQ ID NO: 6449):APVKT (SEQ ID NO: 6379):SAIS (SEQ ID NO: 6360), ASAAPXX (SEQ ID NO: 6437):VPQAL (SEQ ID NO: 6410):SAIS (SEQ ID NO: 6360), ASASPXX (SEQ ID NO: 6438):VSQDL (SEQ ID NO: 6429):SAIS (SEQ ID NO: 6360), ASASPXX (SEQ ID NO: 6438):VPQDL (SEQ ID NO: 6411):SAIS (SEQ ID NO: 6360), SSVKXQP (SEQ ID NO: 6451):SRVHH (SEQ ID NO: 6382):SAIS (SEQ ID NO: 6360), RNVQXRP (SEQ ID NO: 6448):TQVQL (SEQ ID NO: 6393):SAIS (SEQ ID NO: 6360), KIPKAXX (SEQ ID NO: 6445):VPEEL (SEQ ID NO: 6404):SSLS (SEQ ID NO: 6365), SIPKAXX (SEQ ID NO: 6450):VPEEL (SEQ ID NO: 6404):SSLS (SEQ ID NO: 6365), HVTKPTX (SEQ ID NO: 6443):VPEKL (SEQ ID NO: 6405):SSLS (SEQ ID NO: 6365), YVPKPXX (SEQ ID NO: 6454):VPEKL (SEQ ID NO: 6405):SSLS (SEQ ID NO: 6365), TVPKPXX (SEQ ID NO: 6453):VPEQL (SEQ ID NO: 6408):SSLS (SEQ ID NO: 6365), AVPKAXX (SEQ ID NO: 6439):VPEKL (SEQ ID NO: 6405):SSLS (SEQ ID NO: 6365), KVGKAXX (SEQ ID NO: 6446):VPEKL (SEQ ID NO: 6405):SSLS (SEQ ID NO: 6365), KASKAXX (SEQ ID NO: 6444):VPEKL (SEQ ID NO: 6405):SSLS (SEQ ID NO: 6365), GSAGPXX (SEQ ID NO: 6441):VPEKM (SEQ ID NO: 6406):SSLS (SEQ ID NO: 6365), AAPASXX (SEQ ID NO: 6436):VPERL (SEQ ID NO: 6409):SSLS (SEQ ID NO: 6365), STPPTXX (SEQ ID NO: 6452):VPERL (SEQ ID NO: 6409):SSLS (SEQ ID NO: 6365), HVPKPXX (SEQ ID NO: 6442):VPEKL (SEQ ID NO: 6405):SSLS (SEQ ID NO: 6365), RVPSTXX (SEQ ID NO: 6449):VPEKT (SEQ ID NO: 6407):SSLS (SEQ ID NO: 6365), ASAAPXX (SEQ ID NO: 6437):VPEAL (SEQ ID NO: 6402):SSLS (SEQ ID NO: 6365), ASASPXX (SEQ ID NO: 6438):VPEDL (SEQ ID NO: 6403):SSLS (SEQ ID NO: 6365), KIPKAXX (SEQ ID NO: 6445):VPTEL (SEQ ID NO: 6421):SSLS (SEQ ID NO: 6365), SIPKAXX (SEQ ID NO: 6450):VPTEL (SEQ ID NO: 6421):SSLS (SEQ ID NO: 6365), HVTKPTX (SEQ ID NO: 6443):APTKL (SEQ ID NO: 6369):SSLS (SEQ ID NO: 6365), YVPKPXX (SEQ ID NO: 6454):APTKL (SEQ ID NO: 6369):SSLS (SEQ ID NO: 6365), TVPKPXX (SEQ ID NO: 6453):APTQL (SEQ ID NO: 6372):SSLS (SEQ ID NO: 6365), AVPKAXX (SEQ ID NO: 6439):APTKL (SEQ ID NO: 6369):SSLS (SEQ ID NO: 6365), KVGKAXX (SEQ ID NO: 6446):VPTKL (SEQ ID NO: 6423):SSLS (SEQ ID NO: 6365), KASKAXX (SEQ ID NO: 6444):VPTKL (SEQ ID NO: 6423):SSLS (SEQ ID NO: 6365), GSAGPXX (SEQ ID NO: 6441):TPTKM (SEQ ID NO: 6388):SSLS (SEQ ID NO: 6365), AAPASXX (SEQ ID NO: 6436):VPARL (SEQ ID NO: 6401):SSLS (SEQ ID NO: 6365), STPPTXX (SEQ ID NO: 6452):VPTRL (SEQ ID NO: 6427):SSLS (SEQ ID NO: 6365), HVPKPXX (SEQ ID NO: 6442):APTKL (SEQ ID NO: 6369):SSLS (SEQ ID NO: 6365), RVPSTXX (SEQ ID NO: 6449):APVKT (SEQ ID NO: 6379):SSLS (SEQ ID NO: 6365), ASAAPXX (SEQ ID NO: 6437):VPQAL (SEQ ID NO: 6410):SSLS (SEQ ID NO: 6365), ASASPXX (SEQ ID NO: 6438):VSQDL (SEQ ID NO: 6429):SSLS (SEQ ID NO: 6365), ASASPXX (SEQ ID NO: 6438):VPQDL (SEQ ID NO: 6411):SSLS (SEQ ID NO: 6365), NDEGLEX (SEQ ID NO: 6447):VPTEE (SEQ ID NO: 6420):SSLS (SEQ ID NO: 6365), NDEGLEX (SEQ ID NO: 6447):VPTGQ (SEQ ID NO: 6422):SSLS (SEQ ID NO: 6365), SSVKXQP (SEQ ID NO: 6451):SRVHH (SEQ ID NO: 6382):SSLS (SEQ ID NO: 6365), RNVQXRP (SEQ ID NO: 6448):TQVQL (SEQ ID NO: 6393):SSLS (SEQ ID NO: 6365), KIPKAXX (SEQ ID NO: 6445):APTEL (SEQ ID NO: 6368):NAIS (SEQ ID NO: 6357), GIPEPXX (SEQ ID NO: 6440):APTKM (SEQ ID NO: 6370):NAIS (SEQ ID NO: 6357), SIPKAXX (SEQ ID NO: 6450):APTEL (SEQ ID NO: 6368):NAIS (SEQ ID NO: 6357), AVPKAXX (SEQ ID NO: 6439):APTKL (SEQ ID NO: 6369):NAIS (SEQ ID NO: 6357), KVGKAXX (SEQ ID NO: 6446):APTKL (SEQ ID NO: 6369):NAIS (SEQ ID NO: 6357), KASKAXX (SEQ ID NO: 6444): APTKL (SEQ ID NO: 6369):NAIS (SEQ ID NO: 6357), GSAGPXX (SEQ ID NO: 6441):APTKM (SEQ ID NO: 6370):NAIS (SEQ ID NO: 6357), AAPASXX (SEQ ID NO: 6436):APTRL (SEQ ID NO: 6373):NAIS (SEQ ID NO: 6357), STPPTXX (SEQ ID NO: 6452):APTRL (SEQ ID NO: 6373):NAIS (SEQ ID NO: 6357), RVPSTXX (SEQ ID NO: 6449):APTKT (SEQ ID NO: 6371):NAIS (SEQ ID NO: 6357), ASAAPXX (SEQ ID NO: 6437):APTAL (SEQ ID NO: 6366):NAIS (SEQ ID NO: 6357), ASASPXX (SEQ ID NO: 6438):APTDL (SEQ ID NO: 6367):NAIS (SEQ ID NO: 6357), KIPKAXX (SEQ ID NO: 6445):VPTEL (SEQ ID NO: 6421):NAIS (SEQ ID NO: 6357), GIPEPXX (SEQ ID NO: 6440):VPEKM (SEQ ID NO: 6406):NAIS (SEQ ID NO: 6357), SIPKAXX (SEQ ID NO: 6450):VPTEL (SEQ ID NO: 6421):NAIS (SEQ ID NO: 6357), KVGKAXX (SEQ ID NO: 6446):VPTKL (SEQ ID NO: 6423):NAIS (SEQ ID NO: 6357), KASKAXX (SEQ ID NO: 6444): VPTKL (SEQ ID NO: 6423):NAIS (SEQ ID NO: 6357), GSAGPXX (SEQ ID NO: 6441):TPTKM (SEQ ID NO: 6388):NAIS (SEQ ID NO: 6357), AAPASXX (SEQ ID NO: 6436):VPARL (SEQ ID NO: 6401):NAIS (SEQ ID NO: 6357), STPPTXX (SEQ ID NO: 6452):VPTRL (SEQ ID NO: 6427):NAIS (SEQ ID NO: 6357), RVPSTXX (SEQ ID NO: 6449):APVKT (SEQ ID NO: 6379):NAIS (SEQ ID NO: 6357), ASAAPXX (SEQ ID NO: 6437):VPQAL (SEQ ID NO: 6410):NAIS (SEQ ID NO: 6357), ASASPXX (SEQ ID NO: 6438):VSQDL (SEQ ID NO: 6429):NAIS (SEQ ID NO: 6357), ASASPXX (SEQ ID NO: 6438):VPQDL (SEQ ID NO: 6411):NAIS (SEQ ID NO: 6357), NDEGLEX (SEQ ID NO: 6447):VPTEE (SEQ ID NO: 6420):NAIS (SEQ ID NO: 6357), NDEGLEX (SEQ ID NO: 6447):VPTGQ (SEQ ID NO: 6422):NAIS (SEQ ID NO: 6357), SSVKXQP (SEQ ID NO: 6451):SRVHH (SEQ ID NO: 6382):NAIS (SEQ ID NO: 6357), RNVQXRP (SEQ ID NO: 6448):TQVQL (SEQ ID NO: 6393):NAIS (SEQ ID NO: 6357), KIPKAXX (SEQ ID NO: 6445):APTEL (SEQ ID NO: 6368):SATS (SEQ ID NO: 6361), GIPEPXX (SEQ ID NO: 6440):APTKM (SEQ ID NO: 6370):SATS (SEQ ID NO: 6361), SIPKAXX (SEQ ID NO: 6450):APTEL (SEQ ID NO: 6368):SATS (SEQ ID NO: 6361), HVTKPTX (SEQ ID NO: 6443):APTKL (SEQ ID NO: 6369):SATS (SEQ ID NO: 6361), YVPKPXX (SEQ ID NO: 6454):APTKL (SEQ ID NO: 6369):SATS (SEQ ID NO: 6361), TVPKPXX (SEQ ID NO: 6453):APTQL (SEQ ID NO: 6372):SATS (SEQ ID NO: 6361), KVGKAXX (SEQ ID NO: 6446):APTKL (SEQ ID NO: 6369):SATS (SEQ ID NO: 6361), KASKAXX (SEQ ID NO: 6444): APTKL (SEQ ID NO: 6369):SATS (SEQ ID NO: 6361), GSAGPXX (SEQ ID NO: 6441):APTKM (SEQ ID NO: 6370):SATS (SEQ ID NO: 6361), AAPASXX (SEQ ID NO: 6436):APTRL (SEQ ID NO: 6373):SATS (SEQ ID NO: 6361), STPPTXX (SEQ ID NO: 6452):APTRL (SEQ ID NO: 6373):SATS (SEQ ID NO: 6361), HVPKPXX (SEQ ID NO: 6442):APTKL (SEQ ID NO: 6369):SATS (SEQ ID NO: 6361), RVPSTXX (SEQ ID NO: 6449):APTKT (SEQ ID NO: 6371):SATS (SEQ ID NO: 6361), ASAAPXX (SEQ ID NO: 6437):APTAL (SEQ ID NO: 6366):SATS (SEQ ID NO: 6361), ASASPXX (SEQ ID NO: 6438):APTDL (SEQ ID NO: 6367):SATS (SEQ ID NO: 6361), KIPKAXX (SEQ ID NO: 6445):VPTEL (SEQ ID NO: 6421):SATS (SEQ ID NO: 6361), GIPEPXX (SEQ ID NO: 6440):VPEKM (SEQ ID NO: 6406):SATS (SEQ ID NO: 6361), SIPKAXX (SEQ ID NO: 6450):VPTEL (SEQ ID NO: 6421):SATS (SEQ ID NO: 6361), KVGKAXX (SEQ ID NO: 6446):VPTKL (SEQ ID NO: 6423):SATS (SEQ ID NO: 6361), KASKAXX (SEQ ID NO: 6444):VPTKL (SEQ ID NO: 6423):SATS (SEQ ID NO: 6361), GSAGPXX (SEQ ID NO: 6441): TPTKM (SEQ ID NO: 6388):SATS (SEQ ID NO: 6361), AAPASXX (SEQ ID NO: 6436):VPARL (SEQ ID NO: 6401):SATS (SEQ ID NO: 6361), STPPTXX (SEQ ID NO: 6452):VPTRL (SEQ ID NO: 6427):SATS (SEQ ID NO: 6361), RVPSTXX (SEQ ID NO: 6449):APVKT (SEQ ID NO: 6379):SATS (SEQ ID NO: 6361), ASAAPXX (SEQ ID NO: 6437):VPQAL (SEQ ID NO: 6410):SATS (SEQ ID NO: 6361), ASASPXX (SEQ ID NO: 6438):VSQDL (SEQ ID NO: 6429):SATS (SEQ ID NO: 6361), ASASPXX (SEQ ID NO: 6438):VPQDL (SEQ ID NO: 6411):SATS (SEQ ID NO: 6361), NDEGLEX (SEQ ID NO: 6447):VPTEE (SEQ ID NO: 6420):SATS (SEQ ID NO: 6361), NDEGLEX (SEQ ID NO: 6447):VPTGQ (SEQ ID NO: 6422):SATS (SEQ ID NO: 6361), SSVKXQP (SEQ ID NO: 6451):SRVHH (SEQ ID NO: 6382):SATS (SEQ ID NO: 6361), RNVQXRP (SEQ ID NO: 6448):TQVQL (SEQ ID NO: 6393):SATS (SEQ ID NO: 6361), KIPKAXX (SEQ ID NO: 6445):VPTEL (SEQ ID NO: 6421):SPIS (SEQ ID NO: 6364), GIPEPXX (SEQ ID NO: 6440):VPTKM (SEQ ID NO: 6424):SPIS (SEQ ID NO: 6364), SIPKAXX (SEQ ID NO: 6450):VPTEL (SEQ ID NO: 6421):SPIS (SEQ ID NO: 6364), HVTKPTX (SEQ ID NO: 6443):VPTKL (SEQ ID NO: 6423):SPIS (SEQ ID NO: 6364), YVPKPXX (SEQ ID NO: 6454):VPTKL (SEQ ID NO: 6423):SPIS (SEQ ID NO: 6364), TVPKPXX (SEQ ID NO: 6453):VPTQL (SEQ ID NO: 6426):SPIS (SEQ ID NO: 6364), AVPKAXX (SEQ ID NO: 6439):VPTKL (SEQ ID NO: 6423):SPIS (SEQ ID NO: 6364), KASKAXX (SEQ ID NO: 6444):VPTKL (SEQ ID NO: 6423):SPIS (SEQ ID NO: 6364), GSAGPXX (SEQ ID NO: 6441):VPTKM (SEQ ID NO: 6424):SPIS (SEQ ID NO: 6364), AAPASXX (SEQ ID NO: 6436):VPTRL (SEQ ID NO: 6427):SPIS (SEQ ID NO: 6364), STPPTXX (SEQ ID NO: 6452):VPTRL (SEQ ID NO: 6427):SPIS (SEQ ID NO: 6364), HVPKPXX (SEQ ID NO: 6442):VPTKL (SEQ ID NO: 6423):SPIS (SEQ ID NO: 6364), RVPSTXX (SEQ ID NO: 6449):VPTKT (SEQ ID NO: 6425):SPIS (SEQ ID NO: 6364), ASAAPXX (SEQ ID NO: 6437):VPTAL (SEQ ID NO: 6418):SPIS (SEQ ID NO: 6364), ASASPXX (SEQ ID NO: 6438):VPTDL (SEQ ID NO: 6419):SPIS (SEQ ID NO: 6364), GIPEPXX (SEQ ID NO: 6440):VPEKM (SEQ ID NO: 6406):SPIS (SEQ ID NO: 6364), HVTKPTX (SEQ ID NO: 6443):APTKL (SEQ ID NO: 6369):SPIS (SEQ ID NO: 6364), YVPKPXX (SEQ

ID NO: 6454):APTKL (SEQ ID NO: 6369):SPIS (SEQ ID NO: 6364), TVPKPXX (SEQ ID NO: 6453):APTQL (SEQ ID NO: 6372):SPIS (SEQ ID NO: 6364), AVPKAXX (SEQ ID NO: 6439):APTKL (SEQ ID NO: 6369):SPIS (SEQ ID NO: 6364), GSAGPXX (SEQ ID NO: 6441):TPTKM (SEQ ID NO: 6388):SPIS (SEQ ID NO: 6364), AAPASXX (SEQ ID NO: 6436):VPARL (SEQ ID NO: 6401):SPIS (SEQ ID NO: 6364), HVPKPXX (SEQ ID NO: 6442):APTKL (SEQ ID NO: 6369):SPIS (SEQ ID NO: 6364), RVPSTXX (SEQ ID NO: 6449):APVKT (SEQ ID NO: 6379):SPIS (SEQ ID NO: 6364), ASAAPXX (SEQ ID NO: 6437):VPQAL (SEQ ID NO: 6410):SPIS (SEQ ID NO: 6364), ASASPXX (SEQ ID NO: 6438):VSQDL (SEQ ID NO: 6429):SPIS (SEQ ID NO: 6364), ASASPXX (SEQ ID NO: 6438):VPQDL (SEQ ID NO: 6411):SPIS (SEQ ID NO: 6364), SSVKXQP (SEQ ID NO: 6451):SRVHH (SEQ ID NO: 6382):SPIS (SEQ ID NO: 6364), RNVQXRP (SEQ ID NO: 6448):TQVQL (SEQ ID NO: 6393):SPIS (SEQ ID NO: 6364), KIPKAXX (SEQ ID NO: 6445):VPTEL (SEQ ID NO: 6421):EPIS (SEQ ID NO: 6353), GIPEPXX (SEQ ID NO: 6440):VPTKM (SEQ ID NO: 6424):EPIS (SEQ ID NO: 6353), SIPKAXX (SEQ ID NO: 6450):VPTEL (SEQ ID NO: 6421):EPIS (SEQ ID NO: 6353), HVTKPTX (SEQ ID NO: 6443):VPTKL (SEQ ID NO: 6423):EPIS (SEQ ID NO: 6353), YVPKPXX (SEQ ID NO: 6454):VPTKL (SEQ ID NO: 6423):EPIS (SEQ ID NO: 6353), TVPKPXX (SEQ ID NO: 6453):VPTQL (SEQ ID NO: 6426):EPIS (SEQ ID NO: 6353), AVPKAXX (SEQ ID NO: 6439):VPTKL (SEQ ID NO: 6423):EPIS (SEQ ID NO: 6353), KVGKAXX (SEQ ID NO: 6446):VPTKL (SEQ ID NO: 6423):EPIS (SEQ ID NO: 6353), GSAGPXX (SEQ ID NO: 6441):VPTKM (SEQ ID NO: 6424):EPIS (SEQ ID NO: 6353), AAPASXX (SEQ ID NO: 6436):VPTRL (SEQ ID NO: 6427):EPIS (SEQ ID NO: 6353), STPPTXX (SEQ ID NO: 6452):VPTRL (SEQ ID NO: 6427):EPIS (SEQ ID NO: 6353), HVPKPXX (SEQ ID NO: 6442):VPTKL (SEQ ID NO: 6423):EPIS (SEQ ID NO: 6353), RVPSTXX (SEQ ID NO: 6449):VPTKT (SEQ ID NO: 6425):EPIS (SEQ ID NO: 6353), ASAAPXX (SEQ ID NO: 6437):VPTAL (SEQ ID NO: 6418):EPIS (SEQ ID NO: 6353), ASASPXX (SEQ ID NO: 6438):VPTDL (SEQ ID NO: 6419):EPIS (SEQ ID NO: 6353), GIPEPXX (SEQ ID NO: 6440):VPEKM (SEQ ID NO: 6406):EPIS (SEQ ID NO: 6353), HVTKPTX (SEQ ID NO: 6443):APTKL (SEQ ID NO: 6369):EPIS (SEQ ID NO: 6353), YVPKPXX (SEQ ID NO: 6454):APTKL (SEQ ID NO: 6369):EPIS (SEQ ID NO: 6353), TVPKPXX (SEQ ID NO: 6453):APTQL (SEQ ID NO: 6372):EPIS (SEQ ID NO: 6353), AVPKAXX (SEQ ID NO: 6439):APTKL (SEQ ID NO: 6369):EPIS (SEQ ID NO: 6353), GSAGPXX (SEQ ID NO: 6441):TPTKM (SEQ ID NO: 6388):EPIS (SEQ ID NO: 6353), AAPASXX (SEQ ID NO: 6436):VPARL (SEQ ID NO: 6401):EPIS (SEQ ID NO: 6353), HVPKPXX (SEQ ID NO: 6442):APTKL (SEQ ID NO: 6369):EPIS (SEQ ID NO: 6353), RVPSTXX (SEQ ID NO: 6449):APVKT (SEQ ID NO: 6379):EPIS (SEQ ID NO: 6353), ASAAPXX (SEQ ID NO: 6437):VPQAL (SEQ ID NO: 6410):EPIS (SEQ ID NO: 6353), ASASPXX (SEQ ID NO: 6438):VSQDL (SEQ ID NO: 6429):EPIS (SEQ ID NO: 6353), ASASPXX (SEQ ID NO: 6438):VPQDL (SEQ ID NO: 6411):EPIS (SEQ ID NO: 6353), SSVKXQP (SEQ ID NO: 6451):SRVHH (SEQ ID NO: 6382):EPIS (SEQ ID NO: 6353), RNVQXRP (SEQ ID NO: 6448):TQVQL (SEQ ID NO: 6393):EPIS (SEQ ID NO: 6353), KIPKAXX (SEQ ID NO: 6445):TPTEL (SEQ ID NO: 6386):SPIN (SEQ ID NO: 6363), GIPEPXX (SEQ ID NO: 6440):TPTKM (SEQ ID NO: 6388):SPIN (SEQ ID NO: 6363), SIPKAXX (SEQ ID NO: 6450):TPTEL (SEQ ID NO: 6386):SPIN (SEQ ID NO: 6363), HVTKPTX (SEQ ID NO: 6443):TPTKL (SEQ ID NO: 6387):SPIN (SEQ ID NO: 6363), YVPKPXX (SEQ ID NO: 6454):TPTKL (SEQ ID NO: 6387):SPIN (SEQ ID NO: 6363), TVPKPXX (SEQ ID NO: 6453):TPTQL (SEQ ID NO: 6390):SPIN (SEQ ID NO: 6363), AVPKAXX (SEQ ID NO: 6439):TPTKL (SEQ ID NO: 6387):SPIN (SEQ ID NO: 6363), KVGKAXX (SEQ ID NO: 6446):TPTKL (SEQ ID NO: 6387):SPIN (SEQ ID NO: 6363), KASKAXX (SEQ ID NO: 6444):TPTKL (SEQ ID NO: 6387):SPIN (SEQ ID NO: 6363), AAPASXX (SEQ ID NO: 6436):TPTRL (SEQ ID NO: 6391):SPIN (SEQ ID NO: 6363), STPPTXX (SEQ ID NO: 6452):TPTRL (SEQ ID NO: 6391):SPIN (SEQ ID NO: 6363), HVPKPXX (SEQ ID NO: 6442):TPTKL (SEQ ID NO: 6387):SPIN (SEQ ID NO: 6363), RVPSTXX (SEQ ID NO: 6449):TPTKT (SEQ ID NO: 6389):SPIN (SEQ ID NO: 6363), ASAAPXX (SEQ ID NO: 6437):TPTAL (SEQ ID NO: 6384):SPIN (SEQ ID NO: 6363), ASASPXX (SEQ ID NO: 6438):TPTDL (SEQ ID NO: 6385):SPIN (SEQ ID NO: 6363), KIPKAXX (SEQ ID NO: 6445):VPTEL (SEQ ID NO: 6421):SPIN (SEQ ID NO: 6363), GIPEPXX (SEQ ID NO: 6440):VPEKM (SEQ ID NO: 6406):SPIN (SEQ ID NO: 6363), SIPKAXX (SEQ ID NO: 6450):VPTEL (SEQ ID NO: 6421):SPIN (SEQ ID NO: 6363), HVTKPTX (SEQ ID NO: 6443):APTKL (SEQ ID NO: 6369):SPIN (SEQ ID NO: 6363), YVPKPXX (SEQ ID NO: 6454):APTKL (SEQ ID NO: 6369):SPIN (SEQ ID NO: 6363), TVPKPXX (SEQ ID NO: 6453):APTQL (SEQ ID NO: 6372):SPIN (SEQ ID NO: 6363), AVPKAXX (SEQ ID NO: 6439):APTKL (SEQ ID NO: 6369):SPIN (SEQ ID NO: 6363), KVGKAXX (SEQ ID NO: 6446):VPTKL (SEQ ID NO: 6423):SPIN (SEQ ID NO: 6363), KASKAXX (SEQ ID NO: 6444):VPTKL (SEQ ID NO: 6423):SPIN (SEQ ID NO: 6363), AAPASXX (SEQ ID NO: 6436):VPARL (SEQ ID NO: 6401):SPIN (SEQ ID NO: 6363), STPPTXX (SEQ ID NO: 6452):VPTRL (SEQ ID NO: 6427):SPIN (SEQ ID NO: 6363), HVPKPXX (SEQ ID NO: 6442):APTKL (SEQ ID NO: 6369):SPIN (SEQ ID NO: 6363), RVPSTXX (SEQ ID NO: 6449):APVKT (SEQ ID NO: 6379):SPIN (SEQ ID NO: 6363), ASAAPXX (SEQ ID NO: 6437):VPQAL (SEQ ID NO: 6410):SPIN (SEQ ID NO: 6363), ASASPXX (SEQ ID NO: 6438):VSQDL (SEQ ID NO: 6429):SPIN (SEQ ID NO: 6363), ASASPXX (SEQ ID NO: 6438):VPQDL (SEQ ID NO: 6411):SPIN (SEQ ID NO: 6363), NDEGLEX (SEQ ID NO: 6447):VPTEE (SEQ ID NO: 6420):SPIN (SEQ ID NO: 6363), NDEGLEX (SEQ ID NO: 6447):VPTGQ (SEQ ID NO: 6422):SPIN (SEQ ID NO: 6363), SSVKXQP (SEQ ID NO: 6451):SRVHH (SEQ ID NO: 6382):SPIN (SEQ ID NO: 6363), RNVQXRP (SEQ ID NO: 6448):TQVQL (SEQ ID NO: 6393):SPIN (SEQ ID NO: 6363), KIPKAXX (SEQ ID NO: 6445):VPAEL (SEQ ID NO: 6396):SPIS (SEQ ID NO: 6364), GIPEPXX (SEQ ID NO: 6440):VPAKM (SEQ ID NO: 6398):SPIS (SEQ ID NO: 6364), SIPKAXX (SEQ ID NO: 6450):VPAEL (SEQ ID NO: 6396):SPIS (SEQ ID NO: 6364), HVTKPTX (SEQ ID NO: 6443):VPAKL (SEQ ID NO: 6397):SPIS (SEQ ID NO: 6364), YVPKPXX (SEQ ID NO: 6454):VPAKL (SEQ ID NO: 6397):SPIS (SEQ ID NO: 6364), TVPKPXX (SEQ ID NO: 6453):VPAQL (SEQ ID NO: 6400):SPIS (SEQ ID NO: 6364), AVPKAXX (SEQ ID NO: 6439):VPAKL (SEQ ID NO: 6397):SPIS (SEQ ID NO: 6364), KVGKAXX (SEQ ID NO: 6446):VPAKL (SEQ ID NO: 6397):SPIS (SEQ ID NO: 6364), KASKAXX (SEQ ID NO: 6444):VPAKL (SEQ ID NO: 6397):SPIS (SEQ ID NO: 6364), GSAGPXX (SEQ ID NO: 6441):VPAKM (SEQ ID NO: 6398):SPIS (SEQ ID NO: 6364), STPPTXX (SEQ ID NO: 6452):VPARL (SEQ ID NO: 6401):SPIS (SEQ ID NO: 6364), HVPKPXX (SEQ ID NO: 6442):VPAKL (SEQ ID NO: 6397):SPIS (SEQ ID NO: 6364), RVPSTXX (SEQ ID NO: 6449):VPAKT (SEQ ID NO: 6399):SPIS (SEQ ID

NO: 6364), ASAAPXX (SEQ ID NO: 6437):VPAAL (SEQ ID NO: 6394):SPIS (SEQ ID NO: 6364), ASASPXX (SEQ ID NO: 6438):VPADL (SEQ ID NO: 6395):SPIS (SEQ ID NO: 6364), KVGKAXX (SEQ ID NO: 6446):VPTKL (SEQ ID NO: 6423):SPIS (SEQ ID NO: 6364), NDEGLEX (SEQ ID NO: 6447):VPTEE (SEQ ID NO: 6420):SPIS (SEQ ID NO: 6364), NDEGLEX (SEQ ID NO: 6447):VPTGQ (SEQ ID NO: 6422):SPIS (SEQ ID NO: 6364), KIPKAXX (SEQ ID NO: 6445):APVEL (SEQ ID NO: 6376):KPLS (SEQ ID NO: 6356), GIPEPXX (SEQ ID NO: 6440):APVKM (SEQ ID NO: 6378):KPLS (SEQ ID NO: 6356), SIPKAXX (SEQ ID NO: 6450):APVEL (SEQ ID NO: 6376):KPLS (SEQ ID NO: 6356), HVTKPTX (SEQ ID NO: 6443):APVKL (SEQ ID NO: 6377):KPLS (SEQ ID NO: 6356), YVPKPXX (SEQ ID NO: 6454):APVKL (SEQ ID NO: 6377):KPLS (SEQ ID NO: 6356), TVPKPXX (SEQ ID NO: 6453):APVQL (SEQ ID NO: 6380):KPLS (SEQ ID NO: 6356), AVPKAXX (SEQ ID NO: 6439):APVKL (SEQ ID NO: 6377):KPLS (SEQ ID NO: 6356), KVGKAXX (SEQ ID NO: 6446):APVKL (SEQ ID NO: 6377):KPLS (SEQ ID NO: 6356), KASKAXX (SEQ ID NO: 6444):APVKL (SEQ ID NO: 6377):KPLS (SEQ ID NO: 6356), GSAGPXX (SEQ ID NO: 6441): APVKM (SEQ ID NO: 6378):KPLS (SEQ ID NO: 6356), AAPASXX (SEQ ID NO: 6436):APVRL (SEQ ID NO: 6381):KPLS (SEQ ID NO: 6356), STPPTXX (SEQ ID NO: 6452):APVRL (SEQ ID NO: 6381):KPLS (SEQ ID NO: 6356), HVPKPXX (SEQ ID NO: 6442):APVKL (SEQ ID NO: 6377):KPLS (SEQ ID NO: 6356), ASAAPXX (SEQ ID NO: 6437):APVAL (SEQ ID NO: 6374):KPLS (SEQ ID NO: 6356), ASASPXX (SEQ ID NO: 6438):APVDL (SEQ ID NO: 6375):KPLS (SEQ ID NO: 6356), KIPKAXX (SEQ ID NO: 6445):VPTEL (SEQ ID NO: 6421):KPLS (SEQ ID NO: 6356), GIPEPXX (SEQ ID NO: 6440):VPEKM (SEQ ID NO: 6406):KPLS (SEQ ID NO: 6356), SIPKAXX (SEQ ID NO: 6450):VPTEL (SEQ ID NO: 6421):KPLS (SEQ ID NO: 6356), HVTKPTX (SEQ ID NO: 6443):APTKL (SEQ ID NO: 6369):KPLS (SEQ ID NO: 6356), YVPKPXX (SEQ ID NO: 6454):APTKL (SEQ ID NO: 6369):KPLS (SEQ ID NO: 6356), TVPKPXX (SEQ ID NO: 6453):APTQL (SEQ ID NO: 6372):KPLS (SEQ ID NO: 6356), AVPKAXX (SEQ ID NO: 6439):APTKL (SEQ ID NO: 6369):KPLS (SEQ ID NO: 6356), KVGKAXX (SEQ ID NO: 6446):VPTKL (SEQ ID NO: 6423):KPLS (SEQ ID NO: 6356), KASKAXX (SEQ ID NO: 6444):VPTKL (SEQ ID NO: 6423):KPLS (SEQ ID NO: 6356), GSAGPXX (SEQ ID NO: 6441): TPTKM (SEQ ID NO: 6388):KPLS (SEQ ID NO: 6356), AAPASXX (SEQ ID NO: 6436):VPARL (SEQ ID NO: 6401):KPLS (SEQ ID NO: 6356), STPPTXX (SEQ ID NO: 6452):VPTRL (SEQ ID NO: 6427):KPLS (SEQ ID NO: 6356), HVPKPXX (SEQ ID NO: 6442):APTKL (SEQ ID NO: 6369):KPLS (SEQ ID NO: 6356), ASAAPXX (SEQ ID NO: 6437):VPQAL (SEQ ID NO: 6410):KPLS (SEQ ID NO: 6356), ASASPXX (SEQ ID NO: 6438):VSQDL (SEQ ID NO: 6429):KPLS (SEQ ID NO: 6356), ASASPXX (SEQ ID NO: 6438):VPQDL (SEQ ID NO: 6411):KPLS (SEQ ID NO: 6356), NDEGLEX (SEQ ID NO: 6447):VPTEE (SEQ ID NO: 6420):KPLS (SEQ ID NO: 6356), NDEGLEX (SEQ ID NO: 6447):VPTGQ (SEQ ID NO: 6422):KPLS (SEQ ID NO: 6356), SSVKXQP (SEQ ID NO: 6451):SRVHH (SEQ ID NO: 6382):KPLS (SEQ ID NO: 6356), RNVQXRP (SEQ ID NO: 6448):TQVQL (SEQ ID NO: 6393):KPLS (SEQ ID NO: 6356), KIPKAXX (SEQ ID NO: 6445):VPQEL (SEQ ID NO: 6412):EPLP (SEQ ID NO: 6354), GIPEPXX (SEQ ID NO: 6440):VPQKM (SEQ ID NO: 6414):EPLP (SEQ ID NO: 6354), SIPKAXX (SEQ ID NO: 6450):VPQEL (SEQ ID NO: 6412):EPLP (SEQ ID NO: 6354), HVTKPTX (SEQ ID NO: 6443):VPQKL (SEQ ID NO: 6413):EPLP (SEQ ID NO: 6354), YVPKPXX (SEQ ID NO: 6454):VPQKL (SEQ ID NO: 6413):EPLP (SEQ ID NO: 6354), TVPKPXX (SEQ ID NO: 6453):VPQQL (SEQ ID NO: 6416):EPLP (SEQ ID NO: 6354), AVPKAXX (SEQ ID NO: 6439):VPQKL (SEQ ID NO: 6413):EPLP (SEQ ID NO: 6354), KVGKAXX (SEQ ID NO: 6446):VPQKL (SEQ ID NO: 6413):EPLP (SEQ ID NO: 6354), KASKAXX (SEQ ID NO: 6444): VPQKL (SEQ ID NO: 6413):EPLP (SEQ ID NO: 6354), GSAGPXX (SEQ ID NO: 6441):VPQKM (SEQ ID NO: 6414):EPLP (SEQ ID NO: 6354), AAPASXX (SEQ ID NO: 6436):VPQRL (SEQ ID NO: 6417):EPLP (SEQ ID NO: 6354), STPPTXX (SEQ ID NO: 6452):VPQRL (SEQ ID NO: 6417):EPLP (SEQ ID NO: 6354), HVPKPXX (SEQ ID NO: 6442):VPQKL (SEQ ID NO: 6413):EPLP (SEQ ID NO: 6354), RVPSTXX (SEQ ID NO: 6449):VPQKT (SEQ ID NO: 6415):EPLP (SEQ ID NO: 6354), ASASPXX (SEQ ID NO: 6438):VPQDL (SEQ ID NO: 6411):EPLP (SEQ ID NO: 6354), KIPKAXX (SEQ ID NO: 6445):VPTEL (SEQ ID NO: 6421):EPLP (SEQ ID NO: 6354), GIPEPXX (SEQ ID NO: 6440):VPEKM (SEQ ID NO: 6406):EPLP (SEQ ID NO: 6354), SIPKAXX (SEQ ID NO: 6450):VPTEL (SEQ ID NO: 6421):EPLP (SEQ ID NO: 6354), HVTKPTX (SEQ ID NO: 6443):APTKL (SEQ ID NO: 6369):EPLP (SEQ ID NO: 6354), YVPKPXX (SEQ ID NO: 6454):APTKL (SEQ ID NO: 6369):EPLP (SEQ ID NO: 6354), TVPKPXX (SEQ ID NO: 6453):APTQL (SEQ ID NO: 6372):EPLP (SEQ ID NO: 6354), AVPKAXX (SEQ ID NO: 6439):APTKL (SEQ ID NO: 6369):EPLP (SEQ ID NO: 6354), KVGKAXX (SEQ ID NO: 6446):VPTKL (SEQ ID NO: 6423):EPLP (SEQ ID NO: 6354), KASKAXX (SEQ ID NO: 6444): VPTKL (SEQ ID NO: 6423):EPLP (SEQ ID NO: 6354), GSAGPXX (SEQ ID NO: 6441):TPTKM (SEQ ID NO: 6388):EPLP (SEQ ID NO: 6354), AAPASXX (SEQ ID NO: 6436):VPARL (SEQ ID NO: 6401):EPLP (SEQ ID NO: 6354), STPPTXX (SEQ ID NO: 6452):VPTRL (SEQ ID NO: 6427):EPLP (SEQ ID NO: 6354), HVPKPXX (SEQ ID NO: 6442):APTKL (SEQ ID NO: 6369):EPLP (SEQ ID NO: 6354), RVPSTXX (SEQ ID NO: 6449):APVKT (SEQ ID NO: 6379):EPLP (SEQ ID NO: 6354), ASASPXX (SEQ ID NO: 6438):VSQDL (SEQ ID NO: 6429):EPLP (SEQ ID NO: 6354), NDEGLEX (SEQ ID NO: 6447):VPTEE (SEQ ID NO: 6420):EPLP (SEQ ID NO: 6354), NDEGLEX (SEQ ID NO: 6447):VPTGQ (SEQ ID NO: 6422):EPLP (SEQ ID NO: 6354), SSVKXQP (SEQ ID NO: 6451):SRVHH (SEQ ID NO: 6382):EPLP (SEQ ID NO: 6354), RNVQXRP (SEQ ID NO: 6448):TQVQL (SEQ ID NO: 6393):EPLP (SEQ ID NO: 6354), KIPKAXX (SEQ ID NO: 6445):VSQEL (SEQ ID NO: 6430):EPLT (SEQ ID NO: 6355), GIPEPXX (SEQ ID NO: 6440):VSQKM (SEQ ID NO: 6432):EPLT (SEQ ID NO: 6355), SIPKAXX (SEQ ID NO: 6450):VSQEL (SEQ ID NO: 6430):EPLT (SEQ ID NO: 6355), HVTKPTX (SEQ ID NO: 6443):VSQKL (SEQ ID NO: 6431):EPLT (SEQ ID NO: 6355), YVPKPXX (SEQ ID NO: 6454):VSQKL (SEQ ID NO: 6431):EPLT (SEQ ID NO: 6355), TVPKPXX (SEQ ID NO: 6453):VSQQL (SEQ ID NO: 6434):EPLT (SEQ ID NO: 6355), AVPKAXX (SEQ ID NO: 6439):VSQKL (SEQ ID NO: 6431):EPLT (SEQ ID NO: 6355), KVGKAXX (SEQ ID NO: 6446):VSQKL (SEQ ID NO: 6431):EPLT (SEQ ID NO: 6355), KASKAXX (SEQ ID NO: 6444): VSQKL (SEQ ID NO: 6431):EPLT (SEQ ID NO: 6355), GSAGPXX (SEQ ID NO: 6441):VSQKM (SEQ ID NO: 6432):EPLT (SEQ ID NO: 6355), AAPASXX (SEQ ID NO: 6436):VSQRL (SEQ ID NO: 6435):EPLT (SEQ ID NO: 6355), STPPTXX (SEQ ID NO: 6452):VSQRL (SEQ ID NO: 6435):EPLT (SEQ ID NO: 6355), HVPKPXX (SEQ ID NO: 6442):VSQKL (SEQ ID NO: 6431):EPLT (SEQ ID NO: 6355), RVPSTXX (SEQ ID NO: 6449):VSQKT (SEQ

ID NO: 6433):EPLT (SEQ ID NO: 6355), ASAAPXX (SEQ ID NO: 6437):VSQAL (SEQ ID NO: 6428):EPLT (SEQ ID NO: 6355), ASASPXX (SEQ ID NO: 6438):VSQDL (SEQ ID NO: 6429):EPLT (SEQ ID NO: 6355), KIPKAXX (SEQ ID NO: 6445):VPTEL (SEQ ID NO: 6421):EPLT (SEQ ID NO: 6355), GIPEPXX (SEQ ID NO: 6440):VPEKM (SEQ ID NO: 6406):EPLT (SEQ ID NO: 6355), SIPKAXX (SEQ ID NO: 6450):VPTEL (SEQ ID NO: 6421):EPLT (SEQ ID NO: 6355), HVTKPTX (SEQ ID NO: 6443):APTKL (SEQ ID NO: 6369):EPLT (SEQ ID NO: 6355), YVPKPXX (SEQ ID NO: 6454):APTKL (SEQ ID NO: 6369):EPLT (SEQ ID NO: 6355), TVPKPXX (SEQ ID NO: 6453):APTQL (SEQ ID NO: 6372):EPLT (SEQ ID NO: 6355), AVPKAXX (SEQ ID NO: 6439):APTKL (SEQ ID NO: 6369):EPLT (SEQ ID NO: 6355), KVGKAXX (SEQ ID NO: 6446):VPTKL (SEQ ID NO: 6423):EPLT (SEQ ID NO: 6355), KASKAXX (SEQ ID NO: 6444):VPTKL (SEQ ID NO: 6423):EPLT (SEQ ID NO: 6355), GSAGPXX (SEQ ID NO: 6441):TPTKM (SEQ ID NO: 6388):EPLT (SEQ ID NO: 6355), AAPASXX (SEQ ID NO: 6436):VPARL (SEQ ID NO: 6401):EPLT (SEQ ID NO: 6355), STPPTXX (SEQ ID NO: 6452):VPTRL (SEQ ID NO: 6427):EPLT (SEQ ID NO: 6355), HVPKPXX (SEQ ID NO: 6442):APTKL (SEQ ID NO: 6369):EPLT (SEQ ID NO: 6355), RVPSTXX (SEQ ID NO: 6449):APVKT (SEQ ID NO: 6379):EPLT (SEQ ID NO: 6355), ASAAPXX (SEQ ID NO: 6437):VPQAL (SEQ ID NO: 6410):EPLT (SEQ ID NO: 6355), NDEGLEX (SEQ ID NO: 6447):VPTEE (SEQ ID NO: 6420):EPLT (SEQ ID NO: 6355), NDEGLEX (SEQ ID NO: 6447):VPTGQ (SEQ ID NO: 6422):EPLT (SEQ ID NO: 6355), SSVKXQP (SEQ ID NO: 6451):SRVHH (SEQ ID NO: 6382):EPLT (SEQ ID NO: 6355), RNVQXRP (SEQ ID NO: 6448):TQVQL (SEQ ID NO: 6393):EPLT (SEQ ID NO: 6355), KIPKAXX (SEQ ID NO: 6445):VPQEL (SEQ ID NO: 6412):EPLT (SEQ ID NO: 6355), GIPEPXX (SEQ ID NO: 6440):VPQKM (SEQ ID NO: 6414):EPLT (SEQ ID NO: 6355), SIPKAXX (SEQ ID NO: 6450):VPQEL (SEQ ID NO: 6412):EPLT (SEQ ID NO: 6355), HVTKPTX (SEQ ID NO: 6443):VPQKL (SEQ ID NO: 6413):EPLT (SEQ ID NO: 6355), YVPKPXX (SEQ ID NO: 6454):VPQKL (SEQ ID NO: 6413):EPLT (SEQ ID NO: 6355), TVPKPXX (SEQ ID NO: 6453):VPQQL (SEQ ID NO: 6416):EPLT (SEQ ID NO: 6355), AVPKAXX (SEQ ID NO: 6439):VPQKL (SEQ ID NO: 6413):EPLT (SEQ ID NO: 6355), KVGKAXX (SEQ ID NO: 6446):VPQKL (SEQ ID NO: 6413):EPLT (SEQ ID NO: 6355), KASKAXX (SEQ ID NO: 6444):VPQKL (SEQ ID NO: 6413):EPLT (SEQ ID NO: 6355), GSAGPXX (SEQ ID NO: 6441):VPQKM (SEQ ID NO: 6414):EPLT (SEQ ID NO: 6355), AAPASXX (SEQ ID NO: 6436):VPQRL (SEQ ID NO: 6417):EPLT (SEQ ID NO: 6355), STPPTXX (SEQ ID NO: 6452):VPQRL (SEQ ID NO: 6417):EPLT (SEQ ID NO: 6355), HVPKPXX (SEQ ID NO: 6442):VPQKL (SEQ ID NO: 6413):EPLT (SEQ ID NO: 6355), RVPSTXX (SEQ ID NO: 6449):VPQKT (SEQ ID NO: 6415):EPLT (SEQ ID NO: 6355), ASASPXX (SEQ ID NO: 6438):VPQDL (SEQ ID NO: 6411):EPLT (SEQ ID NO: 6355), NDEGLEX (SEQ ID NO: 6447):VPTGQ (SEQ ID NO: 6422):SNIT (SEQ ID NO: 6362), GIPEPXX (SEQ ID NO: 6440):VPEKM (SEQ ID NO: 6406):SNIT (SEQ ID NO: 6362), HVTKPTX (SEQ ID NO: 6443):APTKL (SEQ ID NO: 6369):SNIT (SEQ ID NO: 6362), YVPKPXX (SEQ ID NO: 6454):APTKL (SEQ ID NO: 6369):SNIT (SEQ ID NO: 6362), TVPKPXX (SEQ ID NO: 6453):APTQL (SEQ ID NO: 6372):SNIT (SEQ ID NO: 6362), AVPKAXX (SEQ ID NO: 6439):APTKL (SEQ ID NO: 6369):SNIT (SEQ ID NO: 6362), GSAGPXX (SEQ ID NO: 6441):TPTKM (SEQ ID NO: 6388):SNIT (SEQ ID NO: 6362), AAPASXX (SEQ ID NO: 6436):VPARL (SEQ ID NO: 6401):SNIT (SEQ ID NO: 6362), HVPKPXX (SEQ ID NO: 6442):APTKL (SEQ ID NO: 6369):SNIT (SEQ ID NO: 6362), RVPSTXX (SEQ ID NO: 6449):APVKT (SEQ ID NO: 6379):SNIT (SEQ ID NO: 6362), ASAAPXX (SEQ ID NO: 6437):VPQAL (SEQ ID NO: 6410):SNIT (SEQ ID NO: 6362), ASASPXX (SEQ ID NO: 6438):VSQDL (SEQ ID NO: 6429):SNIT (SEQ ID NO: 6362), ASASPXX (SEQ ID NO: 6438):VPQDL (SEQ ID NO: 6411):SNIT (SEQ ID NO: 6362), SSVKXQP (SEQ ID NO: 6451):SRVHH (SEQ ID NO: 6382):SNIT (SEQ ID NO: 6362), RNVQXRP (SEQ ID NO: 6448):TQVQL (SEQ ID NO: 6393):SNIT (SEQ ID NO: 6362), RNVQXRP (SEQ ID NO: 6448):SRVQL (SEQ ID NO: 6383):RSVK (SEQ ID NO: 6359), KIPKAXX (SEQ ID NO: 6445):VPTEL (SEQ ID NO: 6421):RSVK (SEQ ID NO: 6359), GIPEPXX (SEQ ID NO: 6440):VPEKM (SEQ ID NO: 6406):RSVK (SEQ ID NO: 6359), SIPKAXX (SEQ ID NO: 6450):VPTEL (SEQ ID NO: 6421):RSVK (SEQ ID NO: 6359), HVTKPTX (SEQ ID NO: 6443):APTKL (SEQ ID NO: 6369):RSVK (SEQ ID NO: 6359), YVPKPXX (SEQ ID NO: 6454):APTKL (SEQ ID NO: 6369):RSVK (SEQ ID NO: 6359), TVPKPXX (SEQ ID NO: 6453):APTQL (SEQ ID NO: 6372):RSVK (SEQ ID NO: 6359), AVPKAXX (SEQ ID NO: 6439):APTKL (SEQ ID NO: 6369):RSVK (SEQ ID NO: 6359), KVGKAXX (SEQ ID NO: 6446):VPTKL (SEQ ID NO: 6423):RSVK (SEQ ID NO: 6359), KASKAXX (SEQ ID NO: 6444):VPTKL (SEQ ID NO: 6423):RSVK (SEQ ID NO: 6359), GSAGPXX (SEQ ID NO: 6441):TPTKM (SEQ ID NO: 6388):RSVK (SEQ ID NO: 6359), AAPASXX (SEQ ID NO: 6436):VPARL (SEQ ID NO: 6401):RSVK (SEQ ID NO: 6359), STPPTXX (SEQ ID NO: 6452):VPTRL (SEQ ID NO: 6427):RSVK (SEQ ID NO: 6359), HVPKPXX (SEQ ID NO: 6442):APTKL (SEQ ID NO: 6369):RSVK (SEQ ID NO: 6359), RVPSTXX (SEQ ID NO: 6449):APVKT (SEQ ID NO: 6379):RSVK (SEQ ID NO: 6359), ASAAPXX (SEQ ID NO: 6437):VPQAL (SEQ ID NO: 6410):RSVK (SEQ ID NO: 6359), ASASPXX (SEQ ID NO: 6438):VSQDL (SEQ ID NO: 6429):RSVK (SEQ ID NO: 6359), ASASPXX (SEQ ID NO: 6438):VPQDL (SEQ ID NO: 6411):RSVK (SEQ ID NO: 6359), NDEGLEX (SEQ ID NO: 6447):VPTEE (SEQ ID NO: 6420):RSVK (SEQ ID NO: 6359), NDEGLEX (SEQ ID NO: 6447):VPTGQ (SEQ ID NO: 6422):RSVK (SEQ ID NO: 6359), RNVQXRP (SEQ ID NO: 6448):TQVQL (SEQ ID NO: 6393):RSVK (SEQ ID NO: 6359), SSVKXQP (SEQ ID NO: 6451):TQVHH (SEQ ID NO: 6392):RPVQ (SEQ ID NO: 6358), KIPKAXX (SEQ ID NO: 6445):VPTEL (SEQ ID NO: 6421):RPVQ (SEQ ID NO: 6358), GIPEPXX (SEQ ID NO: 6440):VPEKM (SEQ ID NO: 6406):RPVQ (SEQ ID NO: 6358), SIPKAXX (SEQ ID NO: 6450):VPTEL (SEQ ID NO: 6421):RPVQ (SEQ ID NO: 6358), HVTKPTX (SEQ ID NO: 6443):APTKL (SEQ ID NO: 6369):RPVQ (SEQ ID NO: 6358), YVPKPXX (SEQ ID NO: 6454):APTKL (SEQ ID NO: 6369):RPVQ (SEQ ID NO: 6358), TVPKPXX (SEQ ID NO: 6453):APTQL (SEQ ID NO: 6372):RPVQ (SEQ ID NO: 6358), AVPKAXX (SEQ ID NO: 6439):APTKL (SEQ ID NO: 6369):RPVQ (SEQ ID NO: 6358), KVGKAXX (SEQ ID NO: 6446):VPTKL (SEQ ID NO: 6423):RPVQ (SEQ ID NO: 6358), KASKAXX (SEQ ID NO: 6444):VPTKL (SEQ ID NO: 6423):RPVQ (SEQ ID NO: 6358), GSAGPXX (SEQ ID NO: 6441):TPTKM (SEQ ID NO: 6388):RPVQ (SEQ ID NO: 6358), AAPASXX (SEQ ID NO: 6436):VPARL (SEQ ID NO: 6401):RPVQ (SEQ ID NO: 6358), STPPTXX (SEQ ID NO: 6452):VPTRL (SEQ ID NO: 6427):RPVQ (SEQ ID NO: 6358), HVPKPXX (SEQ ID NO: 6442):APTKL (SEQ ID NO: 6369):RPVQ (SEQ ID NO: 6358), RVPSTXX (SEQ ID NO: 6449):APVKT (SEQ ID NO: 6379):RPVQ (SEQ ID

NO: 6358), ASAAPXX (SEQ ID NO: 6437):VPQAL (SEQ ID NO: 6410):RPVQ (SEQ ID NO: 6358), ASASPXX (SEQ ID NO: 6438):VSQDL (SEQ ID NO: 6429):RPVQ (SEQ ID NO: 6358), ASASPXX (SEQ ID NO: 6438):VPQDL (SEQ ID NO: 6411):RPVQ (SEQ ID NO: 6358), NDEGLEX (SEQ ID NO: 6447):VPTEE (SEQ ID NO: 6420):RPVQ (SEQ ID NO: 6358), NDEGLEX (SEQ ID NO: 6447): VPTGQ (SEQ ID NO: 6422):RPVQ (SEQ ID NO: 6358) and SSVKXQP (SEQ ID NO: 6451):SRVHH (SEQ ID NO: 6382):RPVQ (SEQ ID NO: 6358).

In certain embodiments, the triplet PEP7:PEP5:PEP12 is selected from the group consisting of GIPEPXX (SEQ ID NO: 6440):VPTKM (SEQ ID NO: 6424):SAIS-AA17-LYL (SEQ ID NO: 6598), HVTKPTX (SEQ ID NO: 6443): VPTKL (SEQ ID NO: 6423):SAIS-AA17-LYL (SEQ ID NO: 6598), YVPKPXX (SEQ ID NO: 6454):VPTKL (SEQ ID NO: 6423):SAIS-AA17-LYL (SEQ ID NO: 6598), TVPKPXX (SEQ ID NO: 6453):VPTQL (SEQ ID NO: 6426):SAIS-AA17-LYL (SEQ ID NO: 6598), AVPKAXX (SEQ ID NO: 6439):VPTKL (SEQ ID NO: 6423):SAIS-AA17-LYL (SEQ ID NO: 6598), KVGKAXX (SEQ ID NO: 6446):VPTKL (SEQ ID NO: 6423):SAIS-AA17-LYL (SEQ ID NO: 6598), KASKAXX (SEQ ID NO: 6444):VPTKL (SEQ ID NO: 6423):SAIS-AA17-LYL (SEQ ID NO: 6598), GSAGPXX (SEQ ID NO: 6441):VPTKM (SEQ ID NO: 6424):SAIS-AA17-LYL (SEQ ID NO: 6598), AAPASXX (SEQ ID NO: 6436):VPTRL (SEQ ID NO: 6427):SAIS-AA17-LYL (SEQ ID NO: 6598), STPPTXX (SEQ ID NO: 6452):VPTRL (SEQ ID NO: 6427):SAIS-AA17-LYL (SEQ ID NO: 6598), HVPKPXX (SEQ ID NO: 6442):VPTKL (SEQ ID NO: 6423):SAIS-AA17-LYL (SEQ ID NO: 6598), RVPSTXX (SEQ ID NO: 6449):VPTKT (SEQ ID NO: 6425):SAIS-AA17-LYL (SEQ ID NO: 6598), ASAAPXX (SEQ ID NO: 6437):VPTAL (SEQ ID NO: 6418):SAIS-AA17-LYL (SEQ ID NO: 6598), ASASPXX (SEQ ID NO: 6438):VPTDL (SEQ ID NO: 6419):SAIS-AA17-LYL (SEQ ID NO: 6598), GIPEPXX (SEQ ID NO: 6440):VPEKM (SEQ ID NO: 6406):SAIS-AA17-LYL (SEQ ID NO: 6598), HVTKPTX (SEQ ID NO: 6443):APTKL (SEQ ID NO: 6369):SAIS-AA17-LYL (SEQ ID NO: 6598), YVPKPXX (SEQ ID NO: 6454):APTKL (SEQ ID NO: 6369):SAIS-AA17-LYL (SEQ ID NO: 6598), TVPKPXX (SEQ ID NO: 6453):APTQL (SEQ ID NO: 6372):SAIS-AA17-LYL (SEQ ID NO: 6598), AVPKAXX (SEQ ID NO: 6439):APTKL (SEQ ID NO: 6369):SAIS-AA17-LYL (SEQ ID NO: 6598), GSAGPXX (SEQ ID NO: 6441):TPTKM (SEQ ID NO: 6388):SAIS-AA17-LYL (SEQ ID NO: 6598), AAPASXX (SEQ ID NO: 6436):VPARL (SEQ ID NO: 6401):SAIS-AA17-LYL (SEQ ID NO: 6598), HVPKPXX (SEQ ID NO: 6442):APTKL (SEQ ID NO: 6369):SAIS-AA17-LYL (SEQ ID NO: 6598), RVPSTXX (SEQ ID NO: 6449):APVKT (SEQ ID NO: 6379):SAIS-AA17-LYL (SEQ ID NO: 6598), ASAAPXX (SEQ ID NO: 6437):VPQAL (SEQ ID NO: 6410):SAIS-AA17-LYL (SEQ ID NO: 6598), ASASPXX (SEQ ID NO: 6438):VSQDL (SEQ ID NO: 6429):SAIS-AA17-LYL (SEQ ID NO: 6598), ASASPXX (SEQ ID NO: 6438):VPQDL (SEQ ID NO: 6411):SAIS-AA17-LYL (SEQ ID NO: 6598), SSVKXQP (SEQ ID NO: 6451):SRVHH (SEQ ID NO: 6382):SAIS-AA17-LYL (SEQ ID NO: 6598), RNVQXRP (SEQ ID NO: 6448):TQVQL (SEQ ID NO: 6393):SAIS-AA17-LYL (SEQ ID NO: 6598), KIPKAXX (SEQ ID NO: 6445):VPEEL (SEQ ID NO: 6404):SSLS-AA17-LFF (SEQ ID NO: 6605), SIPKAXX (SEQ ID NO: 6450):VPEEL (SEQ ID NO: 6404):SSLS-AA17-LFF (SEQ ID NO: 6605), HVTKPTX (SEQ ID NO: 6443):VPEKL (SEQ ID NO: 6405):SSLS-AA17-LFF (SEQ ID NO: 6605), YVPKPXX (SEQ ID NO: 6454):VPEKL (SEQ ID NO: 6405):SSLS-AA17-LFF (SEQ ID NO: 6605), TVPKPXX (SEQ ID NO: 6453):VPEQL (SEQ ID NO: 6408):SSLS-AA17-LFF (SEQ ID NO: 6605), AVPKAXX (SEQ ID NO: 6439):VPEKL (SEQ ID NO: 6405):SSLS-AA17-LFF (SEQ ID NO: 6605), KVGKAXX (SEQ ID NO: 6446):VPEKL (SEQ ID NO: 6405):SSLS-AA17-LFF (SEQ ID NO: 6605), KASKAXX (SEQ ID NO: 6444):VPEKL (SEQ ID NO: 6405):SSLS-AA17-LFF (SEQ ID NO: 6605), GSAGPXX (SEQ ID NO: 6441):VPEKM (SEQ ID NO: 6406):SSLS-AA17-LFF (SEQ ID NO: 6605), AAPASXX (SEQ ID NO: 6436):VPERL (SEQ ID NO: 6409):SSLS-AA17-LFF (SEQ ID NO: 6605), STPPTXX (SEQ ID NO: 6452):VPERL (SEQ ID NO: 6409):SSLS-AA17-LFF (SEQ ID NO: 6605), HVPKPXX (SEQ ID NO: 6442):VPEKL (SEQ ID NO: 6405):SSLS-AA17-LFF (SEQ ID NO: 6605), RVPSTXX (SEQ ID NO: 6449):VPEKT (SEQ ID NO: 6407):SSLS-AA17-LFF (SEQ ID NO: 6605), ASAAPXX (SEQ ID NO: 6437):VPEAL (SEQ ID NO: 6402):SSLS-AA17-LFF (SEQ ID NO: 6605), ASASPXX (SEQ ID NO: 6438):VPEDL (SEQ ID NO: 6403):SSLS-AA17-LFF (SEQ ID NO: 6605), KIPKAXX (SEQ ID NO: 6445):VPTEL (SEQ ID NO: 6421):SSLS-AA17-LFF (SEQ ID NO: 6605), SIPKAXX (SEQ ID NO: 6450):VPTEL (SEQ ID NO: 6421):SSLS-AA17-LFF (SEQ ID NO: 6605), HVTKPTX (SEQ ID NO: 6443):APTKL (SEQ ID NO: 6369):SSLS-AA17-LFF (SEQ ID NO: 6605), YVPKPXX (SEQ ID NO: 6454):APTKL (SEQ ID NO: 6369):SSLS-AA17-LFF (SEQ ID NO: 6605), TVPKPXX (SEQ ID NO: 6453):APTQL (SEQ ID NO: 6372):SSLS-AA17-LFF (SEQ ID NO: 6605), AVPKAXX (SEQ ID NO: 6439):APTKL (SEQ ID NO: 6369):SSLS-AA17-LFF (SEQ ID NO: 6605), KVGKAXX (SEQ ID NO: 6446):VPTKL (SEQ ID NO: 6423):SSLS-AA17-LFF (SEQ ID NO: 6605), KASKAXX (SEQ ID NO: 6444):VPTKL (SEQ ID NO: 6423):SSLS-AA17-LFF (SEQ ID NO: 6605), GSAGPXX (SEQ ID NO: 6441):TPTKM (SEQ ID NO: 6388):SSLS-AA17-LFF (SEQ ID NO: 6605), AAPASXX (SEQ ID NO: 6436):VPARL (SEQ ID NO: 6401):SSLS-AA17-LFF (SEQ ID NO: 6605), STPPTXX (SEQ ID NO: 6452):VPTRL (SEQ ID NO: 6427):SSLS-AA17-LFF (SEQ ID NO: 6605), HVPKPXX (SEQ ID NO: 6442):APTKL (SEQ ID NO: 6369):SSLS-AA17-LFF (SEQ ID NO: 6605), RVPSTXX (SEQ ID NO: 6449):APVKT (SEQ ID NO: 6379):SSLS-AA17-LFF (SEQ ID NO: 6605), ASAAPXX (SEQ ID NO: 6437):VPQAL (SEQ ID NO: 6410):SSLS-AA17-LFF (SEQ ID NO: 6605), ASASPXX (SEQ ID NO: 6438):VSQDL (SEQ ID NO: 6429):SSLS-AA17-LFF (SEQ ID NO: 6605), ASASPXX (SEQ ID NO: 6438):VPQDL (SEQ ID NO: 6411):SSLS-AA17-LFF (SEQ ID NO: 6605), NDEGLEX (SEQ ID NO: 6447):VPTEE (SEQ ID NO: 6420):SSLS-AA17-LFF (SEQ ID NO: 6605), NDEGLEX (SEQ ID NO: 6447):VPTGQ (SEQ ID NO: 6422):SSLS-AA17-LFF (SEQ ID NO: 6605), SSVKXQP (SEQ ID NO: 6451):SRVHH (SEQ ID NO: 6382):SSLS-AA17-LFF (SEQ ID NO: 6605), RNVQXRP (SEQ ID NO: 6448):TQVQL (SEQ ID NO: 6393):SSLS-AA17-LFF (SEQ ID NO: 6605), KIPKAXX (SEQ ID NO: 6445):APTEL (SEQ ID NO: 6368):NAIS-AA17-LYF (SEQ ID NO: 6595), GIPEPXX (SEQ ID NO: 6440):APTKM (SEQ ID NO: 6370):NAIS-AA17-LYF (SEQ ID NO: 6595), SIPKAXX (SEQ ID NO: 6450):APTEL (SEQ ID NO: 6368):NAIS-AA17-LYF (SEQ ID NO: 6595), AVPKAXX (SEQ ID NO: 6439):APTKL (SEQ ID NO: 6369):NAIS-AA17-LYF (SEQ ID NO: 6595), KVGKAXX (SEQ ID NO: 6446):APTKL (SEQ ID NO: 6369):NAIS-AA17-LYF (SEQ ID NO: 6595), KASKAXX (SEQ ID NO: 6444):APTKL (SEQ ID NO: 6369):NAIS-AA17-LYF (SEQ ID NO: 6595), GSAGPXX (SEQ ID NO: 6441):APTKM (SEQ ID NO: 6370):NAIS-AA17-LYF (SEQ ID NO: 6595), AAPASXX (SEQ ID NO: 6436): APTRL (SEQ ID NO: 6373):NAIS-AA17-LYF (SEQ ID NO: 6595), STPPTXX (SEQ ID NO: 6452):APTRL (SEQ ID NO: 6373):NAIS-AA17-LYF (SEQ ID NO: 6595), RVPSTXX (SEQ ID NO: 6449):APTKT (SEQ ID NO: 6371): NAIS-AA17-LYF (SEQ ID NO: 6595), ASAAPXX (SEQ ID NO: 6437):APTAL (SEQ ID NO: 6366):NAIS-AA17-LYF (SEQ ID NO: 6595), ASASPXX (SEQ ID NO: 6438): APTDL (SEQ ID NO: 6367):NAIS-AA17-LYF (SEQ ID NO: 6595), KIPKAXX (SEQ ID NO: 6445):VPTEL (SEQ ID NO: 6421):NAIS-AA17-LYF (SEQ ID NO: 6595), GIPEPXX (SEQ ID NO: 6440):VPEKM (SEQ ID NO: 6406):NAIS-AA17-LYF (SEQ ID NO: 6595), SIPKAXX (SEQ ID NO: 6450):VPTEL (SEQ ID NO: 6421):NAIS-AA17-LYF (SEQ ID NO: 6595), KVGKAXX (SEQ ID NO: 6446):VPTKL (SEQ ID NO: 6423):NAIS-AA17-LYF (SEQ ID NO: 6595), KASKAXX (SEQ ID NO: 6444):VPTKL (SEQ ID NO: 6423):NAIS-AA17-LYF (SEQ ID NO: 6595), GSAGPXX (SEQ ID NO: 6441):TPTKM (SEQ ID NO: 6388):NAIS-AA17-LYF (SEQ ID NO: 6595), AAPASXX (SEQ ID NO: 6436):VPARL (SEQ ID NO: 6401):NAIS-AA17-LYF (SEQ ID NO: 6595), STPPTXX (SEQ ID NO: 6452):VPTRL (SEQ ID NO: 6427):NAIS-AA17-LYF (SEQ ID NO: 6595), RVPSTXX (SEQ ID NO: 6449):APVKT (SEQ ID NO: 6379):NAIS-AA17-LYF (SEQ ID NO: 6595), ASAAPXX (SEQ ID NO: 6437):VPQAL (SEQ ID NO: 6410):NAIS-AA17-LYF (SEQ ID NO: 6595), ASASPXX (SEQ ID NO: 6438):VSQDL (SEQ ID NO: 6429):NAIS-AA17-LYF (SEQ ID NO: 6595), ASASPXX (SEQ ID NO: 6438):VPQDL (SEQ ID NO: 6411):NAIS-AA17-LYF (SEQ ID NO: 6595), NDEGLEX (SEQ ID NO: 6447):VPTEE (SEQ ID NO: 6420):NAIS-AA17-LYF (SEQ ID NO: 6595), NDEGLEX (SEQ ID NO: 6447):VPTGQ (SEQ ID NO: 6422):NAIS-AA17-LYF (SEQ ID NO: 6595), SSVKXQP (SEQ ID NO: 6451):SRVHH (SEQ ID NO: 6382):NAIS-AA17-LYF (SEQ ID NO: 6595), RNVQXRP (SEQ ID NO: 6448):TQVQL (SEQ ID NO: 6393):NAIS-AA17-LYF (SEQ ID NO: 6595), KIPKAXX (SEQ ID NO: 6445):APTEL (SEQ ID NO: 6368):SATS-AA17-LYY (SEQ ID NO: 6599), GIPEPXX (SEQ ID NO: 6440):APTKM (SEQ ID NO: 6370):SATS-AA17-LYY (SEQ ID NO: 6599), SIPKAXX (SEQ ID NO: 6450):APTEL (SEQ ID NO: 6368):SATS-AA17-LYY (SEQ ID NO: 6599), HVTKPTX (SEQ ID NO: 6443):APTKL (SEQ ID NO: 6369):SATS-AA17-LYY (SEQ ID NO: 6599), YVPKPXX (SEQ ID NO: 6454):APTKL (SEQ ID NO: 6369):SATS-AA17-LYY (SEQ ID NO: 6599), TVPKPXX (SEQ ID NO: 6453):APTQL (SEQ ID NO: 6372):SATS-AA17-LYY (SEQ ID NO: 6599), KVGKAXX (SEQ ID NO: 6446):APTKL (SEQ ID NO: 6369):SATS-AA17-LYY (SEQ ID NO: 6599), KASKAXX (SEQ ID NO: 6444):APTKL (SEQ ID NO: 6369):SATS-AA17-LYY (SEQ ID NO: 6599), GSAGPXX (SEQ ID NO: 6441):APTKM (SEQ ID NO: 6370):SATS-AA17-LYY (SEQ ID NO: 6599), AAPASXX (SEQ ID NO: 6436):APTRL (SEQ ID NO: 6373):SATS-AA17-LYY (SEQ ID NO: 6599), STPPTXX (SEQ ID NO: 6452):APTRL (SEQ ID NO: 6373):SATS-AA17-LYY (SEQ ID NO: 6599), HVPKPXX (SEQ ID NO: 6442):APTKL (SEQ ID NO: 6369):SATS-AA17-LYY (SEQ ID NO: 6599), RVPSTXX (SEQ ID NO: 6449):APTKT (SEQ ID NO: 6371):SATS-AA17-LYY (SEQ ID NO: 6599), ASAAPXX (SEQ ID NO: 6437):APTAL (SEQ ID NO: 6366):SATS-AA17-LYY (SEQ ID NO: 6599), ASASPXX (SEQ ID NO: 6438):APTDL (SEQ ID NO: 6367):SATS-AA17-LYY (SEQ ID NO: 6599), KIPKAXX (SEQ ID NO: 6445):VPTEL (SEQ ID NO: 6421):SATS-AA17-LYY (SEQ ID NO: 6599), GIPEPXX (SEQ ID NO: 6440):VPEKM (SEQ ID NO: 6406):SATS-AA17-LYY (SEQ ID NO: 6599), SIPKAXX (SEQ ID NO: 6450):VPTEL (SEQ ID NO: 6421):SATS-AA17-LYY (SEQ ID NO: 6599), KVGKAXX (SEQ ID NO: 6446):VPTKL (SEQ ID NO: 6423):SATS-AA17-LYY (SEQ ID NO: 6599), KASKAXX (SEQ ID NO: 6444):VPTKL (SEQ ID NO: 6423):SATS-AA17-LYY (SEQ ID NO: 6599), GSAGPXX (SEQ ID NO: 6441):TPTKM (SEQ ID NO: 6388):SATS-AA17-LYY (SEQ ID NO: 6599), AAPASXX (SEQ ID NO: 6436):VPARL (SEQ ID NO: 6401):SATS-AA17-LYY (SEQ ID NO: 6599), STPPTXX (SEQ ID NO: 6452):VPTRL (SEQ ID NO: 6427):SATS-AA17-LYY (SEQ ID NO: 6599), RVPSTXX (SEQ ID NO: 6449):APVKT (SEQ ID NO: 6379):SATS-AA17-LYY (SEQ ID NO: 6599), ASAAPXX (SEQ ID NO: 6437):VPQAL (SEQ ID NO: 6410):SATS-AA17-LYY (SEQ ID NO: 6599), ASASPXX (SEQ ID NO: 6438):VSQDL (SEQ ID NO: 6429):SATS-AA17-LYY (SEQ ID NO: 6599), ASASPXX (SEQ ID NO: 6438):VPQDL (SEQ ID NO: 6411):SATS-AA17-LYY (SEQ ID NO: 6599), NDEGLEX (SEQ ID NO: 6447):VPTEE (SEQ ID NO: 6420):SATS-AA17-LYY (SEQ ID NO: 6599), NDEGLEX (SEQ ID NO: 6447):VPTGQ (SEQ ID NO: 6422):SATS-AA17-LYY (SEQ ID NO: 6599), SSVKXQP (SEQ ID NO: 6451):SRVHH (SEQ ID NO: 6382):SATS-AA17-LYY (SEQ ID NO: 6599), RNVQXRP (SEQ ID NO: 6448):TQVQL (SEQ ID NO: 6393):SATS-AA17-LYY (SEQ ID NO: 6599), KIPKAXX (SEQ ID NO: 6445):VPTEL (SEQ ID NO: 6421):SPIS-AA17-LYK (SEQ ID NO: 6604), GIPEPXX (SEQ ID NO: 6440):VPTKM (SEQ ID NO: 6424):SPIS-AA17-LYK (SEQ ID NO: 6604), SIPKAXX (SEQ ID NO: 6450):VPTEL (SEQ ID NO: 6421):SPIS-AA17-LYK (SEQ ID NO: 6604), HVTKPTX (SEQ ID NO: 6443):VPTKL (SEQ ID NO: 6423):SPIS-AA17-LYK (SEQ ID NO: 6604), YVPKPXX (SEQ ID NO: 6454):VPTKL (SEQ ID NO: 6423):SPIS-AA17-LYK (SEQ ID NO: 6604), TVPKPXX (SEQ ID NO: 6453):VPTQL (SEQ ID NO: 6426):SPIS-AA17-LYK (SEQ ID NO: 6604), AVPKAXX (SEQ ID NO: 6439):VPTKL (SEQ ID NO: 6423):SPIS-AA17-LYK (SEQ ID NO: 6604), KASKAXX (SEQ ID NO: 6444):VPTKL (SEQ ID NO: 6423):SPIS-AA17-LYK (SEQ ID NO: 6604), GSAGPXX (SEQ ID NO: 6441):VPTKM (SEQ ID NO: 6424):SPIS-AA17-LYK (SEQ ID NO: 6604), AAPASXX (SEQ ID NO: 6436):VPTRL (SEQ ID NO: 6427):SPIS-AA17-LYK (SEQ ID NO: 6604), STPPTXX (SEQ ID NO: 6452):VPTRL (SEQ ID NO: 6427):SPIS-AA17-LYK (SEQ ID NO: 6604), HVPKPXX (SEQ ID NO: 6442):VPTKL (SEQ ID NO: 6423):SPIS-AA17-LYK (SEQ ID NO: 6604), RVPSTXX (SEQ ID NO: 6449):VPTKT (SEQ ID NO: 6425):SPIS-AA17-LYK (SEQ ID NO: 6604), ASAAPXX (SEQ ID NO: 6437):VPTAL (SEQ ID NO: 6418):SPIS-AA17-LYK (SEQ ID NO: 6604), ASASPXX (SEQ ID NO: 6438):VPTDL (SEQ ID NO: 6419):SPIS-AA17-LYK (SEQ ID NO: 6604), GIPEPXX (SEQ ID NO: 6440):VPEKM (SEQ ID NO: 6406):SPIS-AA17-LYK (SEQ ID NO: 6604), HVTKPTX (SEQ ID NO: 6443):APTKL (SEQ ID NO: 6369):SPIS-AA17-LYK (SEQ ID NO: 6604), YVPKPXX (SEQ ID NO: 6454):APTKL (SEQ ID NO: 6369):SPIS-AA17-LYK (SEQ ID NO: 6604), TVPKPXX (SEQ ID NO: 6453):APTQL (SEQ ID NO: 6372):SPIS-AA17-LYK (SEQ ID NO: 6604), AVPKAXX (SEQ ID NO: 6439):APTKL (SEQ ID NO: 6369):SPIS-AA17-LYK (SEQ ID NO: 6604), GSAGPXX (SEQ ID NO: 6441):TPTKM (SEQ ID NO: 6388):SPIS-AA17-LYK (SEQ ID NO: 6604), AAPASXX (SEQ ID NO: 6436):VPARL (SEQ ID NO: 6401):SPIS-AA17-LYK (SEQ ID NO: 6604), HVPKPXX (SEQ ID NO: 6442):APTKL (SEQ ID NO: 6369):SPIS-AA17-LYK (SEQ ID NO: 6604), RVPSTXX (SEQ ID NO: 6449):APVKT (SEQ ID NO:

6379):SPIS-AA17-LYK (SEQ ID NO: 6604), ASAAPXX (SEQ ID NO: 6437):VPQAL (SEQ ID NO: 6410):SPIS-AA17-LYK (SEQ ID NO: 6604), ASASPXX (SEQ ID NO: 6438):VSQDL (SEQ ID NO: 6429):SPIS-AA17-LYK (SEQ ID NO: 6604), ASASPXX (SEQ ID NO: 6438):VPQDL (SEQ ID NO: 6411):SPIS-AA17-LYK (SEQ ID NO: 6604), SSVKXQP (SEQ ID NO: 6451):SRVHH (SEQ ID NO: 6382):SPIS-AA17-LYK (SEQ ID NO: 6604), RNVQXRP (SEQ ID NO: 6448):TQVQL (SEQ ID NO: 6393):SPIS-AA17-LYK (SEQ ID NO: 6604), KIPKAXX (SEQ ID NO: 6445):VPTEL (SEQ ID NO: 6421):EPIS-AA17-LYL (SEQ ID NO: 6591), GIPEPXX (SEQ ID NO: 6440):VPTKM (SEQ ID NO: 6424):EPIS-AA17-LYL (SEQ ID NO: 6591), SIPKAXX (SEQ ID NO: 6450):VPTEL (SEQ ID NO: 6421):EPIS-AA17-LYL (SEQ ID NO: 6591), HVTKPTX (SEQ ID NO: 6443):VPTKL (SEQ ID NO: 6423):EPIS-AA17-LYL (SEQ ID NO: 6591), YVPKPXX (SEQ ID NO: 6454):VPTKL (SEQ ID NO: 6423):EPIS-AA17-LYL (SEQ ID NO: 6591), TVPKPXX (SEQ ID NO: 6453):VPTQL (SEQ ID NO: 6426):EPIS-AA17-LYL (SEQ ID NO: 6591), AVPKAXX (SEQ ID NO: 6439):VPTKL (SEQ ID NO: 6423):EPIS-AA17-LYL (SEQ ID NO: 6591), KVGKAXX (SEQ ID NO: 6446):VPTKL (SEQ ID NO: 6423):EPIS-AA17-LYL (SEQ ID NO: 6591), GSAGPXX (SEQ ID NO: 6441):VPTKM (SEQ ID NO: 6424):EPIS-AA17-LYL (SEQ ID NO: 6591), AAPASXX (SEQ ID NO: 6436):VPTRL (SEQ ID NO: 6427):EPIS-AA17-LYL (SEQ ID NO: 6591), STPPTXX (SEQ ID NO: 6452):VPTRL (SEQ ID NO: 6427):EPIS-AA17-LYL (SEQ ID NO: 6591), HVPKPXX (SEQ ID NO: 6442):VPTKL (SEQ ID NO: 6423):EPIS-AA17-LYL (SEQ ID NO: 6591), RVPSTXX (SEQ ID NO: 6449):VPTKT (SEQ ID NO: 6425):EPIS-AA17-LYL (SEQ ID NO: 6591), ASAAPXX (SEQ ID NO: 6437):VPTAL (SEQ ID NO: 6418):EPIS-AA17-LYL (SEQ ID NO: 6591), ASASPXX (SEQ ID NO: 6438):VPTDL (SEQ ID NO: 6419):EPIS-AA17-LYL (SEQ ID NO: 6591), GIPEPXX (SEQ ID NO: 6440):VPEKM (SEQ ID NO: 6406):EPIS-AA17-LYL (SEQ ID NO: 6591), HVTKPTX (SEQ ID NO: 6443):APTKL (SEQ ID NO: 6369):EPIS-AA17-LYL (SEQ ID NO: 6591), YVPKPXX (SEQ ID NO: 6454):APTKL (SEQ ID NO: 6369):EPIS-AA17-LYL (SEQ ID NO: 6591), TVPKPXX (SEQ ID NO: 6453):APTQL (SEQ ID NO: 6372):EPIS-AA17-LYL (SEQ ID NO: 6591), AVPKAXX (SEQ ID NO: 6439):APTKL (SEQ ID NO: 6369):EPIS-AA17-LYL (SEQ ID NO: 6591), GSAGPXX (SEQ ID NO: 6441):TPTKM (SEQ ID NO: 6388):EPIS-AA17-LYL (SEQ ID NO: 6591), AAPASXX (SEQ ID NO: 6436):VPARL (SEQ ID NO: 6401):EPIS-AA17-LYL (SEQ ID NO: 6591), HVPKPXX (SEQ ID NO: 6442):APTKL (SEQ ID NO: 6369):EPIS-AA17-LYL (SEQ ID NO: 6591), RVPSTXX (SEQ ID NO: 6449):APVKT (SEQ ID NO: 6379):EPIS-AA17-LYL (SEQ ID NO: 6591), ASAAPXX (SEQ ID NO: 6437):VPQAL (SEQ ID NO: 6410):EPIS-AA17-LYL (SEQ ID NO: 6591), ASASPXX (SEQ ID NO: 6438):VSQDL (SEQ ID NO: 6429):EPIS-AA17-LYL (SEQ ID NO: 6591), ASASPXX (SEQ ID NO: 6438):VPQDL (SEQ ID NO: 6411):EPIS-AA17-LYL (SEQ ID NO: 6591), SSVKXQP (SEQ ID NO: 6451):SRVHH (SEQ ID NO: 6382):EPIS-AA17-LYL (SEQ ID NO: 6591), RNVQXRP (SEQ ID NO: 6448):TQVQL (SEQ ID NO: 6393):EPIS-AA17-LYL (SEQ ID NO: 6591), KIPKAXX (SEQ ID NO: 6445):TPTEL (SEQ ID NO: 6386):SPIN-AA17-LYF (SEQ ID NO: 6601), GIPEPXX (SEQ ID NO: 6440):TPTKM (SEQ ID NO: 6388):SPIN-AA17-LYF (SEQ ID NO: 6601), SIPKAXX (SEQ ID NO: 6450):TPTEL (SEQ ID NO: 6386):SPIN-AA17-LYF (SEQ ID NO: 6601), HVTKPTX (SEQ ID NO: 6443):TPTKL (SEQ ID NO: 6387):SPIN-AA17-LYF (SEQ ID NO: 6601), YVPKPXX (SEQ ID NO: 6454):TPTKL (SEQ ID NO: 6387):SPIN-AA17-LYF (SEQ ID NO: 6601), TVPKPXX (SEQ ID NO: 6453):TPTQL (SEQ ID NO: 6390):SPIN-AA17-LYF (SEQ ID NO: 6601), AVPKAXX (SEQ ID NO: 6439):TPTKL (SEQ ID NO: 6387):SPIN-AA17-LYF (SEQ ID NO: 6601), KVGKAXX (SEQ ID NO: 6446):TPTKL (SEQ ID NO: 6387):SPIN-AA17-LYF (SEQ ID NO: 6601), KASKAXX (SEQ ID NO: 6444):TPTKL (SEQ ID NO: 6387):SPIN-AA17-LYF (SEQ ID NO: 6601), AAPASXX (SEQ ID NO: 6436):TPTRL (SEQ ID NO: 6391):SPIN-AA17-LYF (SEQ ID NO: 6601), STPPTXX (SEQ ID NO: 6452):TPTRL (SEQ ID NO: 6391):SPIN-AA17-LYF (SEQ ID NO: 6601), HVPKPXX (SEQ ID NO: 6442):TPTKL (SEQ ID NO: 6387):SPIN-AA17-LYF (SEQ ID NO: 6601), RVPSTXX (SEQ ID NO: 6449):TPTKT (SEQ ID NO: 6389):SPIN-AA17-LYF (SEQ ID NO: 6601), ASAAPXX (SEQ ID NO: 6437):TPTAL (SEQ ID NO: 6384):SPIN-AA17-LYF (SEQ ID NO: 6601), ASASPXX (SEQ ID NO: 6438):TPTDL (SEQ ID NO: 6385):SPIN-AA17-LYF (SEQ ID NO: 6601), KIPKAXX (SEQ ID NO: 6445):VPTEL (SEQ ID NO: 6421):SPIN-AA17-LYF (SEQ ID NO: 6601), GIPEPXX (SEQ ID NO: 6440):VPEKM (SEQ ID NO: 6406):SPIN-AA17-LYF (SEQ ID NO: 6601), SIPKAXX (SEQ ID NO: 6450):VPTEL (SEQ ID NO: 6421):SPIN-AA17-LYF (SEQ ID NO: 6601), HVTKPTX (SEQ ID NO: 6443):APTKL (SEQ ID NO: 6369):SPIN-AA17-LYF (SEQ ID NO: 6601), YVPKPXX (SEQ ID NO: 6454):APTKL (SEQ ID NO: 6369):SPIN-AA17-LYF (SEQ ID NO: 6601), TVPKPXX (SEQ ID NO: 6453):APTQL (SEQ ID NO: 6372):SPIN-AA17-LYF (SEQ ID NO: 6601), AVPKAXX (SEQ ID NO: 6439):APTKL (SEQ ID NO: 6369):SPIN-AA17-LYF (SEQ ID NO: 6601), KVGKAXX (SEQ ID NO: 6446):VPTKL (SEQ ID NO: 6423):SPIN-AA17-LYF (SEQ ID NO: 6601), KASKAXX (SEQ ID NO: 6444):VPTKL (SEQ ID NO: 6423):SPIN-AA17-LYF (SEQ ID NO: 6601), AAPASXX (SEQ ID NO: 6436):VPARL (SEQ ID NO: 6401):SPIN-AA17-LYF (SEQ ID NO: 6601), STPPTXX (SEQ ID NO: 6452):VPTRL (SEQ ID NO: 6427):SPIN-AA17-LYF (SEQ ID NO: 6601), HVPKPXX (SEQ ID NO: 6442):APTKL (SEQ ID NO: 6369):SPIN-AA17-LYF (SEQ ID NO: 6601), RVPSTXX (SEQ ID NO: 6449):APVKT (SEQ ID NO: 6379):SPIN-AA17-LYF (SEQ ID NO: 6601), ASAAPXX (SEQ ID NO: 6437):VPQAL (SEQ ID NO: 6410):SPIN-AA17-LYF (SEQ ID NO: 6601), ASASPXX (SEQ ID NO: 6438):VSQDL (SEQ ID NO: 6429):SPIN-AA17-LYF (SEQ ID NO: 6601), ASASPXX (SEQ ID NO: 6438):VPQDL (SEQ ID NO: 6411):SPIN-AA17-LYF (SEQ ID NO: 6601), NDEGLEX (SEQ ID NO: 6447):VPTEE (SEQ ID NO: 6420):SPIN-AA17-LYF (SEQ ID NO: 6601), NDEGLEX (SEQ ID NO: 6447):VPTGQ (SEQ ID NO: 6422):SPIN-AA17-LYF (SEQ ID NO: 6601), SSVKXQP (SEQ ID NO: 6451):SRVHH (SEQ ID NO: 6382):SPIN-AA17-LYF (SEQ ID NO: 6601), RNVQXRP (SEQ ID NO: 6448):TQVQL (SEQ ID NO: 6393):SPIN-AA17-LYF (SEQ ID NO: 6601), KIPKAXX (SEQ ID NO: 6445):VPAEL (SEQ ID NO: 6396):SPIS-AA17-LYI (SEQ ID NO: 6603), GIPEPXX (SEQ ID NO: 6440):VPAKM (SEQ ID NO: 6398):SPIS-AA17-LYI (SEQ ID NO: 6603), SIPKAXX (SEQ ID NO: 6450):VPAEL (SEQ ID NO: 6396):SPIS-AA17-LYI (SEQ ID NO: 6603), HVTKPTX (SEQ ID NO: 6443):VPAKL (SEQ ID NO: 6397):SPIS-AA17-LYI (SEQ ID NO: 6603), YVPKPXX (SEQ ID NO: 6454):VPAKL (SEQ ID NO: 6397):SPIS-AA17-LYI (SEQ ID NO: 6603), TVPKPXX (SEQ ID NO: 6453):VPAQL (SEQ ID NO: 6400):SPIS-AA17-LYI (SEQ ID NO: 6603), AVPKAXX (SEQ ID NO: 6439):VPAKL (SEQ ID NO: 6397):SPIS-AA17-LYI (SEQ ID NO: 6603), KVGKAXX (SEQ ID NO: 6446):VPAKL (SEQ ID NO: 6397):SPIS-AA17-LYI (SEQ ID NO: 6603), KASKAXX (SEQ ID NO: 6444):VPAKL (SEQ ID NO: 6397):SPIS-AA17-LYI (SEQ ID NO: 6603), GSAGPXX (SEQ ID NO: 6441):VPAKM (SEQ ID NO: 6398):SPIS-AA17-LYI (SEQ ID NO: 6603), STPPTXX (SEQ ID NO: 6452):VPARL (SEQ ID NO: 6401):SPIS-AA17-LYI (SEQ ID NO: 6603), HVPKPXX (SEQ ID NO: 6442):VPAKL (SEQ ID NO: 6397):SPIS-AA17-LYI (SEQ ID NO: 6603), RVPSTXX (SEQ ID NO: 6449):VPAKT (SEQ ID NO: 6399):SPIS-AA17-LYI (SEQ ID NO: 6603), ASAAPXX (SEQ ID NO: 6437):VPAAL (SEQ ID NO: 6394):SPIS-AA17-LYI (SEQ ID NO: 6603), ASASPXX (SEQ ID NO: 6438):VPADL (SEQ ID NO: 6395):SPIS-AA17-LYI (SEQ ID NO: 6603), KIPKAXX (SEQ ID NO: 6445):VPTEL (SEQ ID NO: 6421):SPIS-AA17-LYI (SEQ ID NO: 6603), GIPEPXX (SEQ ID NO: 6440):VPEKM (SEQ ID NO: 6406):SPIS-AA17-LYI (SEQ ID NO: 6603), SIPKAXX (SEQ ID NO: 6450):VPTEL (SEQ ID NO: 6421):SPIS-AA17-LYI (SEQ ID NO: 6603), HVTKPTX (SEQ ID NO: 6443):APTKL (SEQ ID NO: 6369):SPIS-AA17-LYI (SEQ ID NO: 6603), YVPKPXX (SEQ ID NO: 6454):APTKL (SEQ ID NO: 6369):SPIS-AA17-LYI (SEQ ID NO: 6603), TVPKPXX (SEQ ID NO: 6453):APTQL (SEQ ID NO: 6372):SPIS-AA17-LYI (SEQ ID NO: 6603), AVPKAXX (SEQ ID NO: 6439):APTKL (SEQ ID NO: 6369):SPIS-AA17-LYI (SEQ ID NO: 6603), KVGKAXX (SEQ ID NO: 6446):VPTKL (SEQ ID NO: 6423):SPIS-AA17-LYI (SEQ ID NO: 6603), KASKAXX (SEQ ID NO: 6444):VPTKL (SEQ ID NO: 6423):SPIS-AA17-LYI (SEQ ID NO: 6603), GSAGPXX (SEQ ID NO: 6441):TPTKM (SEQ ID NO: 6388):SPIS-AA17-LYI (SEQ ID NO: 6603), STPPTXX (SEQ ID NO: 6452):VPTRL (SEQ ID NO: 6427):SPIS-AA17-LYI (SEQ ID NO: 6603), HVPKPXX (SEQ ID NO: 6442):APTKL (SEQ ID NO: 6369):SPIS-AA17-LYI (SEQ ID NO: 6603), RVPSTXX (SEQ ID NO: 6449):APVKT (SEQ ID NO: 6379):SPIS-AA17-LYI (SEQ ID NO: 6603), ASAAPXX (SEQ ID NO: 6437):VPQAL (SEQ ID NO: 6410):SPIS-AA17-LYI (SEQ ID NO: 6603), ASASPXX (SEQ ID NO: 6438):VSQDL (SEQ ID NO: 6429):SPIS-AA17-LYI (SEQ ID NO: 6603), ASASPXX (SEQ ID NO: 6438):VPQDL (SEQ ID NO: 6411):SPIS-AA17-LYI (SEQ ID NO: 6603), NDEGLEX (SEQ ID NO: 6447):VPTEE (SEQ ID NO: 6420):SPIS-AA17-LYI (SEQ ID NO: 6603), NDEGLEX (SEQ ID NO: 6447):VPTGQ (SEQ ID NO: 6422):SPIS-AA17-LYI (SEQ ID NO: 6603), SSVKXQP (SEQ ID NO: 6451):SRVHH (SEQ ID NO: 6382):SPIS-AA17-LYI (SEQ ID NO: 6603), RNVQXRP (SEQ ID NO: 6448):TQVQL (SEQ ID NO: 6393):SPIS-AA17-LYI (SEQ ID NO: 6603), KIPKAXX (SEQ ID NO: 6445):VPTEL (SEQ ID NO: 6421):SPIS-AA17-LFI (SEQ ID NO: 6602), GIPEPXX (SEQ ID NO: 6440):VPTKM (SEQ ID NO: 6424):SPIS-AA17-LFI (SEQ ID NO: 6602), SIPKAXX (SEQ ID NO: 6450):VPTEL (SEQ ID NO: 6421):SPIS-AA17-LFI (SEQ ID NO: 6602), HVTKPTX (SEQ ID NO: 6443):VPTKL (SEQ ID NO: 6423):SPIS-AA17-LFI (SEQ ID NO: 6602), YVPKPXX (SEQ ID NO: 6454):VPTKL (SEQ ID NO: 6423):SPIS-AA17-LFI (SEQ ID NO: 6602), TVPKPXX (SEQ ID NO: 6453):VPTQL (SEQ ID NO: 6426):SPIS-AA17-LFI (SEQ ID NO: 6602), AVPKAXX (SEQ ID NO: 6439):VPTKL (SEQ ID NO: 6423):SPIS-AA17-LFI (SEQ ID NO: 6602), KVGKAXX (SEQ ID NO: 6446):VPTKL (SEQ ID NO: 6423):SPIS-AA17-LFI (SEQ ID NO: 6602), KASKAXX (SEQ ID NO: 6444):VPTKL (SEQ ID NO: 6423):SPIS-AA17-LFI (SEQ ID NO: 6602), GSAGPXX (SEQ ID NO: 6441):VPTKM (SEQ ID NO: 6424):SPIS-AA17-LFI (SEQ ID NO: 6602), AAPASXX (SEQ ID NO: 6436):VPTRL (SEQ ID NO: 6427):SPIS-AA17-LFI (SEQ ID NO: 6602), HVPKPXX (SEQ ID NO: 6442):VPTKL (SEQ ID NO: 6423):SPIS-AA17-LFI (SEQ ID NO: 6602), RVPSTXX (SEQ ID NO: 6449):VPTKT (SEQ ID NO: 6425):SPIS-AA17-LFI (SEQ ID NO: 6602), ASAAPXX (SEQ ID NO: 6437):VPTAL (SEQ ID NO: 6418):SPIS-AA17-LFI (SEQ ID NO: 6602), ASASPXX (SEQ ID NO: 6438):VPTDL (SEQ ID NO: 6419):SPIS-AA17-LFI (SEQ ID NO: 6602), GIPEPXX (SEQ ID NO: 6440):VPEKM (SEQ ID NO: 6406):SPIS-AA17-LFI (SEQ ID NO: 6602), HVTKPTX (SEQ ID NO: 6443):APTKL (SEQ ID NO: 6369):SPIS-AA17-LFI (SEQ ID NO: 6602), YVPKPXX (SEQ ID NO: 6454):APTKL (SEQ ID NO: 6369):SPIS-AA17-LFI (SEQ ID NO: 6602), TVPKPXX (SEQ ID NO: 6453):APTQL (SEQ ID NO: 6372):SPIS-AA17-LFI (SEQ ID NO: 6602), AVPKAXX (SEQ ID NO: 6439):APTKL (SEQ ID NO: 6369):SPIS-AA17-LFI (SEQ ID NO: 6602), GSAGPXX (SEQ ID NO: 6441):TPTKM (SEQ ID NO: 6388):SPIS-AA17-LFI (SEQ ID NO: 6602), AAPASXX (SEQ ID NO: 6436):VPARL (SEQ ID NO: 6401):SPIS-AA17-LFI (SEQ ID NO: 6602), HVPKPXX (SEQ ID NO: 6442):APTKL (SEQ ID NO: 6369):SPIS-AA17-LFI (SEQ ID NO: 6602), RVPSTXX (SEQ ID NO: 6449):APVKT (SEQ ID NO: 6379):SPIS-AA17-LFI (SEQ ID NO: 6602), ASAAPXX (SEQ ID NO: 6437):VPQAL (SEQ ID NO: 6410):SPIS-AA17-LFI (SEQ ID NO: 6602), ASASPXX (SEQ ID NO: 6438):VSQDL (SEQ ID NO: 6429):SPIS-AA17-LFI (SEQ ID NO: 6602), ASASPXX (SEQ ID NO: 6438):VPQDL (SEQ ID NO: 6411):SPIS-AA17-LFI (SEQ ID NO: 6602), SSVKXQP (SEQ ID NO: 6451):SRVHH (SEQ ID NO: 6382):SPIS-AA17-LFI (SEQ ID NO: 6602), RNVQXRP (SEQ ID NO: 6448):TQVQL (SEQ ID NO: 6393):SPIS-AA17-LFI (SEQ ID NO: 6602), KIPKAXX (SEQ ID NO: 6445):APVEL (SEQ ID NO: 6376):KPLS-AA17-LYV (SEQ ID NO: 6594), GIPEPXX (SEQ ID NO: 6440): APVKM (SEQ ID NO: 6378):KPLS-AA17-LYV (SEQ ID NO: 6594), SIPKAXX (SEQ ID NO: 6450):APVEL (SEQ ID NO: 6376):KPLS-AA17-LYV (SEQ ID NO: 6594), HVTKPTX (SEQ ID NO: 6443):APVKL (SEQ ID NO: 6377):KPLS-AA17-LYV (SEQ ID NO: 6594), YVPKPXX (SEQ ID NO: 6454):APVKL (SEQ ID NO: 6377):KPLS-AA17-LYV (SEQ ID NO: 6594), TVPKPXX (SEQ ID NO: 6453):APVQL (SEQ ID NO: 6380):KPLS-AA17-LYV (SEQ ID NO: 6594), AVPKAXX (SEQ ID NO: 6439): APVKL (SEQ ID NO: 6377):KPLS-AA17-LYV (SEQ ID NO: 6594), KVGKAXX (SEQ ID NO: 6446):APVKL (SEQ ID NO: 6377):KPLS-AA17-LYV (SEQ ID NO: 6594), KASKAXX (SEQ ID NO: 6444):APVKL (SEQ ID NO: 6377):KPLS-AA17-LYV (SEQ ID NO: 6594), GSAGPXX (SEQ ID NO: 6441):APVKM (SEQ ID NO: 6378):KPLS-AA17-LYV (SEQ ID NO: 6594), AAPASXX (SEQ ID NO: 6436):APVRL (SEQ ID NO: 6381):KPLS-AA17-LYV (SEQ ID NO: 6594), STPPTXX (SEQ ID NO: 6452): APVRL (SEQ ID NO: 6381):KPLS-AA17-LYV (SEQ ID NO: 6594), HVPKPXX (SEQ ID NO: 6442):APVKL (SEQ ID NO: 6377):KPLS-AA17-LYV (SEQ ID NO: 6594), ASAAPXX (SEQ ID NO: 6437):APVAL (SEQ ID NO: 6374):KPLS-AA17-LYV (SEQ ID NO: 6594), ASASPXX (SEQ ID NO: 6438):APVDL (SEQ ID NO: 6375):KPLS-AA17-LYV (SEQ ID NO: 6594), KIPKAXX (SEQ ID NO: 6445):VPTEL (SEQ ID NO: 6421):KPLS-AA17-LYV (SEQ ID NO: 6594), GIPEPXX (SEQ ID NO: 6440): VPEKM (SEQ ID NO: 6406):KPLS-AA17-LYV (SEQ ID NO: 6594), SIPKAXX (SEQ ID NO: 6450):VPTEL (SEQ ID NO: 6421):KPLS-AA17-LYV (SEQ ID NO: 6594), HVTKPTX (SEQ ID NO: 6443):APTKL (SEQ ID NO: 6369):KPLS-AA17-LYV (SEQ ID NO: 6594), YVPKPXX (SEQ ID NO: 6454):APTKL (SEQ ID NO: 6369):KPLS-AA17-LYV (SEQ ID NO: 6594), TVPKPXX (SEQ ID NO: 6453):APTQL (SEQ ID NO: 6372):KPLS-AA17-LYV (SEQ ID NO: 6594), AVPKAXX (SEQ ID NO: 6439): APTKL (SEQ ID NO: 6369):KPLS-AA17-LYV (SEQ ID NO: 6594), KVGKAXX (SEQ ID NO: 6446):VPTKL (SEQ ID NO: 6423):KPLS-AA17-LYV (SEQ ID NO: 6594), KASKAXX (SEQ ID NO: 6444):VPTKL (SEQ ID NO: 6423):KPLS-AA17-LYV (SEQ ID NO: 6594), GSAGPXX (SEQ ID NO: 6441):TPTKM (SEQ ID NO: 6388):KPLS-AA17-LYV (SEQ ID NO: 6594), AAPASXX (SEQ ID NO: 6436):VPARL (SEQ ID NO: 6401):KPLS-AA17-LYV (SEQ ID NO: 6594), STPPTXX (SEQ ID NO: 6452): VPTRL (SEQ ID NO: 6427):KPLS-AA17-LYV (SEQ ID NO: 6594), HVPKPXX (SEQ ID NO: 6442):APTKL (SEQ ID NO: 6369):KPLS-AA17-LYV (SEQ ID NO: 6594), ASAAPXX (SEQ ID NO: 6437):VPQAL (SEQ ID NO: 6410):KPLS-AA17-LYV (SEQ ID NO: 6594), ASASPXX (SEQ ID NO: 6438):VSQDL (SEQ ID NO: 6429):KPLS-AA17-LYV (SEQ ID NO: 6594), ASASPXX (SEQ ID NO: 6438):VPQDL (SEQ ID NO: 6411):KPLS-AA17-LYV (SEQ ID NO: 6594), NDEGLEX (SEQ ID NO: 6447):VPTEE (SEQ ID NO: 6420):KPLS-AA17-LYV (SEQ ID NO: 6594), NDEGLEX (SEQ ID NO: 6447):VPTGQ (SEQ ID NO: 6422):KPLS-AA17-LYV (SEQ ID NO: 6594), SSVKXQP (SEQ ID NO: 6451):SRVHH (SEQ ID NO: 6382):KPLS-AA17-LYV (SEQ ID NO: 6594), RNVQXRP (SEQ ID NO: 6448):TQVQL (SEQ ID NO: 6393):KPLS-AA17-LYV (SEQ ID NO: 6594), KIPKAXX (SEQ ID NO: 6445):VPQEL (SEQ ID NO: 6412):EPLP-AA17-VYY (SEQ ID NO: 6592), GIPEPXX (SEQ ID NO: 6440):VPQKM (SEQ ID NO: 6414):EPLP-AA17-VYY (SEQ ID NO: 6592), SIPKAXX (SEQ ID NO: 6450):VPQEL (SEQ ID NO: 6412):EPLP-AA17-VYY (SEQ ID NO: 6592), HVTKPTX (SEQ ID NO: 6443):VPQKL (SEQ ID NO: 6413):EPLP-AA17-VYY (SEQ ID NO: 6592), YVPKPXX (SEQ ID NO: 6454):VPQKL (SEQ ID NO: 6413):EPLP-AA17-VYY (SEQ ID NO: 6592), TVPKPXX (SEQ ID NO: 6453):VPQQL (SEQ ID NO: 6416):EPLP-AA17-VYY (SEQ ID NO: 6592), AVPKAXX (SEQ ID NO: 6439): VPQKL (SEQ ID NO: 6413):EPLP-AA17-VYY (SEQ ID NO: 6592), KVGKAXX (SEQ ID NO: 6446):VPQKL (SEQ ID NO: 6413):EPLP-AA17-VYY (SEQ ID NO: 6592), KASKAXX (SEQ ID NO: 6444):VPQKL (SEQ ID NO: 6413):EPLP-AA17-VYY (SEQ ID NO: 6592), GSAGPXX (SEQ ID NO: 6441):VPQKM (SEQ ID NO: 6414):EPLP-AA17-VYY (SEQ ID NO: 6592), AAPASXX (SEQ ID NO: 6436):VPQRL (SEQ ID NO: 6417):EPLP-AA17-VYY (SEQ ID NO: 6592), STPPTXX (SEQ ID NO: 6452):VPQRL (SEQ ID NO: 6417):EPLP-AA17-VYY (SEQ ID NO: 6592), HVPKPXX (SEQ ID NO: 6442):VPQKL (SEQ ID NO: 6413):EPLP-AA17-VYY (SEQ ID NO: 6592), RVPSTXX (SEQ ID NO: 6449):VPQKT (SEQ ID NO: 6415):EPLP-AA17-VYY (SEQ ID NO: 6592), ASASPXX (SEQ ID NO: 6438):VPQDL (SEQ ID NO: 6411):EPLP-AA17-VYY (SEQ ID NO: 6592), KIPKAXX (SEQ ID NO: 6445):VPTEL (SEQ ID NO: 6421):EPLP-AA17-VYY (SEQ ID NO: 6592), GIPEPXX (SEQ ID NO: 6440): VPEKM (SEQ ID NO: 6406):EPLP-AA17-VYY (SEQ ID NO: 6592), SIPKAXX (SEQ ID NO: 6450):VPTEL (SEQ ID NO: 6421):EPLP-AA17-VYY (SEQ ID NO: 6592), HVTKPTX (SEQ ID NO: 6443):APTKL (SEQ ID NO: 6369):EPLP-AA17-VYY (SEQ ID NO: 6592), YVPKPXX (SEQ ID NO: 6454):APTKL (SEQ ID NO: 6369):EPLP-AA17-VYY (SEQ ID NO: 6592), TVPKPXX (SEQ ID NO: 6453):APTQL (SEQ ID NO: 6372):EPLP-AA17-VYY (SEQ ID NO: 6592), AVPKAXX (SEQ ID NO: 6439): APTKL (SEQ ID NO: 6369):EPLP-AA17-VYY (SEQ ID NO: 6592), KVGKAXX (SEQ ID NO: 6446):VPTKL (SEQ ID NO: 6423):EPLP-AA17-VYY (SEQ ID NO: 6592), KASKAXX (SEQ ID NO: 6444):VPTKL (SEQ ID NO: 6423):EPLP-AA17-VYY (SEQ ID NO: 6592), GSAGPXX (SEQ ID NO: 6441):TPTKM (SEQ ID NO: 6388):EPLP-AA17-VYY (SEQ ID NO: 6592), AAPASXX (SEQ ID NO: 6436):VPARL (SEQ ID NO: 6401):EPLP-AA17-VYY (SEQ ID NO: 6592), STPPTXX (SEQ ID NO: 6452): VPTRL (SEQ ID NO: 6427):EPLP-AA17-VYY (SEQ ID NO: 6592), HVPKPXX (SEQ ID NO: 6442):APTKL (SEQ ID NO: 6369):EPLP-AA17-VYY (SEQ ID NO: 6592), RVPSTXX (SEQ ID NO: 6449):APVKT (SEQ ID NO: 6379):EPLP-AA17-VYY (SEQ ID NO: 6592), ASASPXX (SEQ ID NO: 6438):VSQDL (SEQ ID NO: 6429):EPLP-AA17-VYY (SEQ ID NO: 6592), NDEGLEX (SEQ ID NO: 6447):VPTEE (SEQ ID NO: 6420):EPLP-AA17-VYY (SEQ ID NO: 6592), NDEGLEX (SEQ ID NO: 6447):VPTGQ (SEQ ID NO: 6422):EPLP-AA17-VYY (SEQ ID NO: 6592), SSVKXQP (SEQ ID NO: 6451):SRVHH (SEQ ID NO: 6382):EPLP-AA17-VYY (SEQ ID NO: 6592), RNVQXRP (SEQ ID NO: 6448):TQVQL (SEQ ID NO: 6393):EPLP-AA17-VYY (SEQ ID NO: 6592), KIPKAXX (SEQ ID NO: 6445):VSQEL (SEQ ID NO: 6430):EPLT-AA17-LYY (SEQ ID NO: 6593), GIPEPXX (SEQ ID NO: 6440):VSQKM (SEQ ID NO: 6432):EPLT-AA17-LYY (SEQ ID NO: 6593), SIPKAXX (SEQ ID NO: 6450): VSQEL (SEQ ID NO: 6430):EPLT-AA17-LYY (SEQ ID NO: 6593), HVTKPTX (SEQ ID NO: 6443):VSQKL (SEQ ID NO: 6431):EPLT-AA17-LYY (SEQ ID NO: 6593), YVPKPXX (SEQ ID NO: 6454):VSQKL (SEQ ID NO: 6431):EPLT-AA17-LYY (SEQ ID NO: 6593), TVPKPXX (SEQ ID NO: 6453):VSQQL (SEQ ID NO: 6434):EPLT-AA17-LYY (SEQ ID NO: 6593), AVPKAXX (SEQ ID NO: 6439):VSQKL (SEQ ID NO: 6431):EPLT-AA17-LYY (SEQ ID NO: 6593), KVGKAXX (SEQ ID NO: 6446):VSQKL (SEQ ID NO: 6431):EPLT-AA17-LYY (SEQ ID NO: 6593), KASKAXX (SEQ ID NO: 6444):VSQKL (SEQ ID NO: 6431):EPLT-AA17-LYY (SEQ ID NO: 6593), GSAGPXX (SEQ ID NO: 6441):VSQKM (SEQ ID NO: 6432):EPLT-AA17-LYY (SEQ ID NO: 6593), AAPASXX (SEQ ID NO: 6436):VSQRL (SEQ ID NO: 6435):EPLT-AA17-LYY (SEQ ID NO: 6593), STPPTXX (SEQ ID NO: 6452):VSQRL (SEQ ID NO: 6435):EPLT-AA17-LYY (SEQ ID NO: 6593), HVPKPXX (SEQ ID NO: 6442):VSQKL (SEQ ID NO: 6431):EPLT-AA17-LYY (SEQ ID NO: 6593), RVPSTXX (SEQ ID NO: 6449):VSQKT (SEQ ID NO: 6433):EPLT-AA17-LYY (SEQ ID NO: 6593), ASAAPXX (SEQ ID NO: 6437):VSQAL (SEQ ID NO: 6428):EPLT-AA17-LYY (SEQ ID NO: 6593), ASASPXX (SEQ ID NO: 6438):VSQDL (SEQ ID NO: 6429):EPLT-AA17-LYY (SEQ ID NO: 6593), KIPKAXX (SEQ ID NO: 6445):VPTEL (SEQ ID NO: 6421):EPLT-AA17-LYY (SEQ ID NO: 6593), GIPEPXX (SEQ ID NO: 6440):VPEKM (SEQ ID NO: 6406):EPLT-AA17-LYY (SEQ ID NO: 6593), SIPKAXX (SEQ ID NO: 6450):VPTEL (SEQ ID NO: 6421):EPLT-AA17-LYY (SEQ ID NO: 6593), HVTKPTX (SEQ ID NO: 6443):APTKL (SEQ ID NO: 6369):EPLT-AA17-LYY (SEQ ID NO: 6593), YVPKPXX (SEQ ID NO: 6454):APTKL (SEQ ID NO: 6369):EPLT-AA17-LYY (SEQ ID NO: 6593), TVPKPXX (SEQ ID NO: 6453):APTQL (SEQ ID NO: 6372):EPLT-AA17-LYY (SEQ ID NO: 6593), AVPKAXX (SEQ ID NO: 6439):APTKL (SEQ ID NO: 6369):EPLT-AA17-LYY (SEQ ID NO: 6593), KVGKAXX (SEQ ID NO: 6446):VPTKL (SEQ ID NO: 6423):EPLT-AA17-LYY (SEQ ID NO: 6593), KASKAXX (SEQ ID NO: 6444):VPTKL (SEQ ID NO: 6423):EPLT-AA17-LYY (SEQ ID NO: 6593), GSAGPXX (SEQ ID NO: 6441):TPTKM (SEQ ID NO: 6388):EPLT-AA17-LYY (SEQ ID NO: 6593), AAPASXX (SEQ ID NO: 6436):VPARL (SEQ ID NO: 6401):EPLT-AA17-LYY (SEQ ID NO: 6593), STPPTXX (SEQ ID NO: 6452):VPTRL (SEQ ID NO: 6427):EPLT-AA17-LYY (SEQ ID NO: 6593), HVPKPXX (SEQ ID NO: 6442):APTKL (SEQ ID NO: 6369):EPLT-AA17-LYY (SEQ ID NO: 6593), RVPSTXX (SEQ ID NO: 6449):APVKT (SEQ ID NO: 6379):EPLT-AA17-LYY (SEQ ID NO: 6593), ASAAPXX (SEQ ID NO: 6437):VPQAL (SEQ ID NO: 6410):EPLT-AA17-LYY (SEQ ID NO: 6593), NDEGLEX (SEQ ID NO: 6447):VPTEE (SEQ ID NO: 6420):EPLT-AA17-LYY (SEQ ID NO: 6593), NDEGLEX (SEQ ID NO: 6447):VPTGQ (SEQ ID NO: 6422):EPLT-AA17-LYY (SEQ ID NO: 6593), SSVKXQP (SEQ ID NO: 6451):SRVHH (SEQ ID NO: 6382):EPLT-AA17-LYY (SEQ ID NO: 6593), RNVQXRP (SEQ ID NO: 6448):TQVQL (SEQ ID NO: 6393):EPLT-AA17-LYY (SEQ ID NO: 6593), KIPKAXX (SEQ ID NO: 6445):VPQEL (SEQ ID NO: 6412):EPLT-AA17-LYY (SEQ ID NO: 6593), GIPEPXX (SEQ ID NO: 6440):VPQKM (SEQ ID NO: 6414):EPLT-AA17-LYY (SEQ ID NO: 6593), SIPKAXX (SEQ ID NO: 6450):VPQEL (SEQ ID NO: 6412):EPLT-AA17-LYY (SEQ ID NO: 6593), HVTKPTX (SEQ ID NO: 6443):VPQKL (SEQ ID NO: 6413):EPLT-AA17-LYY (SEQ ID NO: 6593), YVPKPXX (SEQ ID NO: 6454):VPQKL (SEQ ID NO: 6413):EPLT-AA17-LYY (SEQ ID NO: 6593), TVPKPXX (SEQ ID NO: 6453):VPQQL (SEQ ID NO: 6416):EPLT-AA17-LYY (SEQ ID NO: 6593), AVPKAXX (SEQ ID NO: 6439):VPQKL (SEQ ID NO: 6413):EPLT-AA17-LYY (SEQ ID NO: 6593), KVGKAXX (SEQ ID NO: 6446):VPQKL (SEQ ID NO: 6413):EPLT-AA17-LYY (SEQ ID NO: 6593), KASKAXX (SEQ ID NO: 6444):VPQKL (SEQ ID NO: 6413):EPLT-AA17-LYY (SEQ ID NO: 6593), GSAGPXX (SEQ ID NO: 6441):VPQKM (SEQ ID NO: 6414):EPLT-AA17-LYY (SEQ ID NO: 6593), AAPASXX (SEQ ID NO: 6436):VPQRL (SEQ ID NO: 6417):EPLT-AA17-LYY (SEQ ID NO: 6593), STPPTXX (SEQ ID NO: 6452):VPQRL (SEQ ID NO: 6417):EPLT-AA17-LYY (SEQ ID NO: 6593), HVPKPXX (SEQ ID NO: 6442):VPQKL (SEQ ID NO: 6413):EPLT-AA17-LYY (SEQ ID NO: 6593), RVPSTXX (SEQ ID NO: 6449):VPQKT (SEQ ID NO: 6415):EPLT-AA17-LYY (SEQ ID NO: 6593), ASASPXX (SEQ ID NO: 6438):VPQDL (SEQ ID NO: 6411):EPLT-AA17-LYY (SEQ ID NO: 6593), NDEGLEX (SEQ ID NO: 6447):VPTGQ (SEQ ID NO: 6422):SNIT-AA17-QIM (SEQ ID NO: 6600), GIPEPXX (SEQ ID NO: 6440):VPEKM (SEQ ID NO: 6406):SNIT-AA17-QIM (SEQ ID NO: 6600), HVTKPTX (SEQ ID NO: 6443):APTKL (SEQ ID NO: 6369):SNIT-AA17-QIM (SEQ ID NO: 6600), YVPKPXX (SEQ ID NO: 6454):APTKL (SEQ ID NO: 6369):SNIT-AA17-QIM (SEQ ID NO: 6600), TVPKPXX (SEQ ID NO: 6453):APTQL (SEQ ID NO: 6372):SNIT-AA17-QIM (SEQ ID NO: 6600), AVPKAXX (SEQ ID NO: 6439):APTKL (SEQ ID NO: 6369):SNIT-AA17-QIM (SEQ ID NO: 6600), GSAGPXX (SEQ ID NO: 6441):TPTKM (SEQ ID NO: 6388):SNIT-AA17-QIM (SEQ ID NO: 6600), AAPASXX (SEQ ID NO: 6436):VPARL (SEQ ID NO: 6401):SNIT-AA17-QIM (SEQ ID NO: 6600), HVPKPXX (SEQ ID NO: 6442):APTKL (SEQ ID NO: 6369):SNIT-AA17-QIM (SEQ ID NO: 6600), RVPSTXX (SEQ ID NO: 6449):APVKT (SEQ ID NO: 6379):SNIT-AA17-QIM (SEQ ID NO: 6600), ASAAPXX (SEQ ID NO: 6437):VPQAL (SEQ ID NO: 6410):SNIT-AA17-QIM (SEQ ID NO: 6600), ASASPXX (SEQ ID NO: 6438):VSQDL (SEQ ID NO: 6429):SNIT-AA17-QIM (SEQ ID NO: 6600), ASASPXX (SEQ ID NO: 6438):VPQDL (SEQ ID NO: 6411):SNIT-AA17-QIM (SEQ ID NO: 6600), SSVKXQP (SEQ ID NO: 6451):SRVHH (SEQ ID NO: 6382):SNIT-AA17-QIM (SEQ ID NO: 6600), RNVQXRP (SEQ ID NO: 6448):TQVQL (SEQ ID NO: 6393):SNIT-AA17-QIM (SEQ ID NO: 6600), RNVQXRP (SEQ ID NO: 6448):SRVQL (SEQ ID NO: 6383):RSVK-AA17-AKV (SEQ ID NO: 6597), KIPKAXX (SEQ ID NO: 6445):VPTEL (SEQ ID NO: 6421):RSVK-AA17-AKV (SEQ ID NO: 6597), GIPEPXX (SEQ ID NO: 6440):VPEKM (SEQ ID NO: 6406):RSVK-AA17-AKV (SEQ ID NO: 6597), SIPKAXX (SEQ ID NO: 6450):VPTEL (SEQ ID NO: 6421):RSVK-AA17-AKV (SEQ ID NO: 6597), HVTKPTX (SEQ ID NO: 6443):APTKL (SEQ ID NO: 6369):RSVK-AA17-AKV (SEQ ID NO: 6597), YVPKPXX (SEQ ID NO: 6454):APTKL (SEQ ID NO: 6369):RSVK-AA17-AKV (SEQ ID NO: 6597), TVPKPXX (SEQ ID NO: 6453):APTQL (SEQ ID NO: 6372):RSVK-AA17-AKV (SEQ ID NO: 6597), AVPKAXX (SEQ ID NO: 6439):APTKL (SEQ ID NO: 6369):RSVK-AA17-AKV (SEQ ID NO: 6597), KVGKAXX (SEQ ID NO: 6446):VPTKL (SEQ ID NO: 6423):RSVK-AA17-AKV (SEQ ID NO: 6597), KASKAXX (SEQ ID NO: 6444):VPTKL (SEQ ID NO: 6423):RSVK-AA17-AKV (SEQ ID NO: 6597), GSAGPXX (SEQ ID NO: 6441):TPTKM (SEQ ID NO: 6388):RSVK-AA17-AKV (SEQ ID NO: 6597), AAPASXX (SEQ ID NO: 6436):VPARL (SEQ ID NO: 6401):RSVK-AA17-AKV (SEQ ID NO: 6597), STPPTXX (SEQ ID NO: 6452):VPTRL (SEQ ID NO: 6427):RSVK-AA17-AKV (SEQ ID NO: 6597), HVPKPXX (SEQ ID NO: 6442):APTKL (SEQ ID NO: 6369):RSVK-AA17-AKV (SEQ ID NO: 6597), RVPSTXX (SEQ ID NO: 6449):APVKT (SEQ ID NO: 6379):RSVK-AA17-AKV (SEQ ID NO: 6597), ASAAPXX (SEQ ID NO: 6437):VPQAL (SEQ ID NO: 6410):RSVK-AA17-AKV (SEQ ID NO: 6597), ASASPXX (SEQ ID NO: 6438):VSQDL (SEQ ID NO: 6429):RSVK-AA17-AKV (SEQ ID NO: 6597), ASASPXX (SEQ ID NO: 6438):VPQDL (SEQ ID NO: 6411):RSVK-AA17-AKV (SEQ ID NO: 6597), NDEGLEX (SEQ ID NO: 6447):VPTEE (SEQ ID NO: 6420):RSVK-AA17-AKV (SEQ ID NO: 6597), NDEGLEX (SEQ ID NO: 6447):VPTGQ (SEQ ID NO: 6422):RSVK-AA17-AKV (SEQ ID NO: 6597), RNVQXRP (SEQ ID NO: 6448):TQVQL (SEQ ID NO: 6393):RSVK-AA17-AKV (SEQ ID NO: 6597), SSVKXQP (SEQ ID NO: 6451):TQVHH (SEQ ID NO: 6392):RPVQ-AA17-RKI (SEQ ID NO: 6596), KIPKAXX (SEQ ID NO: 6445):VPTEL (SEQ ID NO: 6421):RPVQ-AA17-RKI (SEQ ID NO: 6596), GIPEPXX (SEQ ID NO: 6440):VPEKM (SEQ ID NO: 6406):RPVQ-AA17-RKI (SEQ ID NO: 6596), SIPKAXX (SEQ ID NO: 6450):VPTEL (SEQ ID NO: 6421):RPVQ-AA17-RKI (SEQ ID NO: 6596), HVTKPTX (SEQ ID NO: 6443):APTKL (SEQ ID NO: 6369):RPVQ-AA17-RKI (SEQ ID NO: 6596), YVPKPXX (SEQ ID NO: 6454):APTKL (SEQ ID NO: 6369):RPVQ-AA17-RKI (SEQ ID NO: 6596), TVPKPXX (SEQ ID NO: 6453):APTQL (SEQ ID NO: 6372):RPVQ-AA17-RKI (SEQ ID NO: 6596), AVPKAXX (SEQ ID NO: 6439):APTKL (SEQ ID NO: 6369):RPVQ-AA17-RKI (SEQ ID NO: 6596), KVGKAXX (SEQ ID NO: 6446):VPTKL (SEQ ID NO: 6423):RPVQ-AA17-RKI (SEQ ID NO: 6596), KASKAXX (SEQ ID NO: 6444):VPTKL (SEQ ID NO: 6423):RPVQ-AA17-RKI (SEQ ID NO: 6596), GSAGPXX (SEQ ID NO: 6441):TPTKM (SEQ ID NO: 6388):RPVQ-AA17-RKI (SEQ ID NO: 6596), AAPASXX (SEQ ID NO: 6436):VPARL (SEQ ID NO: 6401):RPVQ-AA17-RKI (SEQ ID NO: 6596), STPPTXX (SEQ ID NO: 6452):VPTRL (SEQ ID NO: 6427):RPVQ-AA17-RKI (SEQ ID NO: 6596), HVPKPXX (SEQ ID NO: 6442):APTKL (SEQ ID NO: 6369):RPVQ-AA17-RKI (SEQ ID NO: 6596), RVPSTXX (SEQ ID NO:

6449):APVKT (SEQ ID NO: 6379):RPVQ-AA17-RKI (SEQ ID NO: 6596), ASAAPXX (SEQ ID NO: 6437): VPQAL (SEQ ID NO: 6410):RPVQ-AA17-RKI (SEQ ID NO: 6596), ASASPXX (SEQ ID NO: 6438):VSQDL (SEQ ID NO: 6429):RPVQ-AA17-RKI (SEQ ID NO: 6596), ASASPXX (SEQ ID NO: 6438):VPQDL (SEQ ID NO: 6411):RPVQ-AA17-RKI (SEQ ID NO: 6596), NDEGLEX (SEQ ID NO: 6447):VPTEE (SEQ ID NO: 6420):RPVQ-AA17-RKI (SEQ ID NO: 6596), NDEGLEX (SEQ ID NO: 6447):VPTGQ (SEQ ID NO: 6422):RPVQ-AA17-RKI (SEQ ID NO: 6596) and SSVKXQP (SEQ ID NO: 6451): SRVHH (SEQ ID NO: 6382):RPVQ-AA17-RKI (SEQ ID NO: 6596); and wherein $AA^{17}$ is selected from the group consisting of G, A, V, L, I, P, F, M, W, T and S (in particular is selected from the group consisting of M, I, L, V and T).

In certain embodiments, PEP11 is a peptide with 3 amino acids of general formula $AA^{18}$-$AA^{19}$-$AA^{20}$; wherein $AA^{18}$ is selected from the group consisting of L, V, Q, A and R; wherein $AA^{19}$ is selected from the group consisting of F, W, H, Y, I and K; wherein $AA^{20}$ is selected from the group consisting of L, F, Y, K, I, V and M. In one particular example, PEP11 is selected from the group consisting of LYL, LFF, LYF, LYY, LYK, LYI, LFI, LYV, VYY, QIM, AKV and RKI.

In certain embodiments, PEP1 is selected from the group consisting of SAIS (SEQ ID NO: 6360), SSLS (SEQ ID NO: 6365), NAIS (SEQ ID NO: 6357), SATS (SEQ ID NO: 6361), SPIS (SEQ ID NO: 6364), EPIS (SEQ ID NO: 6353), SPIN (SEQ ID NO: 6363), KPLS (SEQ ID NO: 6356), EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358); PEP11 is selected from the group consisting of LYL, LFF, LYF, LYY, LYK, LYI, LFI, LYV, VYY, QIM, AKV and RKI; and the pair PEP1:PEP11 is selected from the group consisting of SAIS (SEQ ID NO: 6360):LYL, SSLS (SEQ ID NO: 6365):LFF, NAIS (SEQ ID NO: 6357):LYF, SATS (SEQ ID NO: 6361):LYY, SPIS (SEQ ID NO: 6364):LYK, SPIS (SEQ ID NO: 6364):LYI, SPIS (SEQ ID NO: 6364):LFI, EPIS (SEQ ID NO: 6353): LYL, SPIN (SEQ ID NO: 6363):LYF, KPLS (SEQ ID NO: 6356):LYV, EPLP (SEQ ID NO: 6354):VYY, EPLT (SEQ ID NO: 6355):LYY, SNIT (SEQ ID NO: 6362):QIM, RSVK (SEQ ID NO: 6359):AKV and RPVQ (SEQ ID NO: 6358): RKI.

In one aspect, the present disclosure provides a GFR-binding compound, wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (III) (hereinafter may also be referred to as compound (III) or peptide (III)):

$AA^1$-$AA^2$-$AA^3$-$AA^4$-$AA^5$-$AA^6$-$AA^7$-$AA^8$-$AA^9$-$AA^{10}$-$AA^{11}$-$AA^{12}$-$AA^{13}$-$AA^{14}$-$AA^{15}$-$AA^{16}$-$AA^{17}$-$AA^{18}$-$AA^{19}$-$AA^{20}$ wherein $AA^1$-$AA^2$-$AA^3$-$AA^4$-$AA^5$-$AA^6$-$AA^7$ (SEQ ID NO: 6606) is PEP7 as defined herein; wherein $AA^{13}$-$AA^{14}$-$AA^{15}$-$AA^{16}$-$AA^{17}$-$AA^{18}$-$AA^{19}$-$AA^{20}$ is PEP12 as defined herein; wherein $AA^8$-$AA^9$-$AA^{10}$ is PEP3 as defined herein; wherein $AA^{11}$ and $AA^{12}$ are as defined herein; wherein $AA^1$ may be an N-terminal amino acid or a C-terminal amino acid; wherein $AA^{20}$ may be an N-terminal amino acid or a C-terminal amino acid; and wherein the RMSD is 2.45 Å or less.

In one example, said GFR-binding compound is a synthetic molecule as defined herein in the definition section.

In one particular example, said GFR-binding compound is a synthetic peptide, or a variant or analog thereof, or a peptidomimetic.

In one most particular example, said GFR-binding compound is a synthetic peptide.

In one example, a length of said GFR-binding compound, in solution, such as in a physiologically acceptable solvent such as water or PBS, is comprised between about 6 and about 20 nm, preferably between about 6 and about 16 nm, as determined using the standard «3D» procedure described above.

In one particular example, said GFR-binding compounds may be any one or a plurality of peptides of SEQ ID NO: 1 to 1085 and 1143 to 6352.

Bone

Certain embodiments of the invention are particularly useful for inducing differentiation of mensenchymal or progenitor stem cells from the bone cell lineage, regenerating bone tissues, repairing bone and protecting from osteoporosis.

In certain embodiments useful for inducing differentiation of mensenchymal or progenitor stem cells from the bone cell lineage, regenerating bone tissues, repairing bone and protecting from osteoporosis, PEP1 is selected from the group consisting of SAIS (SEQ ID NO: 6360), NAIS (SEQ ID NO: 6357), SATS (SEQ ID NO: 6361) and SPIS (SEQ ID NO: 6364).

In certain embodiments useful for inducing differentiation of mensenchymal or progenitor stem cells from the bone cell lineage, regenerating bone tissues, repairing bone and protecting from osteoporosis, PEP3 is selected from the group consisting of VPT, APT, VPQ, VSQ and TQV.

In certain embodiments useful for inducing differentiation of mensenchymal or progenitor stem cells from the bone cell lineage, regenerating bone tissues, repairing bone and protecting from osteoporosis, PEP5 is a peptide of general formula PEP3-$AA^{11}$-$AA^{12}$; wherein PEP3 is selected from the group consisting of VPT, APT, VPQ, VSQ and TQV; wherein $AA^{11}$ is selected from the group consisting of E, K, Q, R, A, D, G and H, in particular E, K, Q, A and D; wherein $AA^{12}$ is selected from the group consisting of L, M, T, E, Q and H, in particular L. In one particular example, PEP5 is selected from the group consisting of VPTEL (SEQ ID NO: 6421), APTKL (SEQ ID NO: 6369), APTQL (SEQ ID NO: 6372), VPTKL (SEQ ID NO: 6423), VPQAL (SEQ ID NO: 6410), VSQDL (SEQ ID NO: 6429), VPQDL (SEQ ID NO: 6411) and TQVQL (SEQ ID NO: 6393).

In certain embodiments useful for inducing differentiation of mensenchymal or progenitor stem cells from the bone cell lineage, regenerating bone tissues, repairing bone and protecting from osteoporosis, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA'$ as defined herein; wherein $AA^6$ is absent or selected from the group consisting of S, T, C, E, Q, P and R, preferably C, S, T or R; wherein $AA^7$ is absent or is selected from the group consisting of S, T, C, E, Q, P and R, preferably is selected from the group consisting of C, S and P; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), ASAAPXX (SEQ ID NO: 6437), ASASPXX (SEQ ID NO: 6438) and RNVQXRP (SEQ ID NO: 6448).

In certain embodiments useful for inducing differentiation of mensenchymal or progenitor stem cells from the bone cell lineage, regenerating bone tissues, repairing bone and protecting from osteoporosis, PEP9 is a peptide of general formula $AA^1-AA^2-AA^3-AA^4-AA^5-AA^6-AA^7$-PEP5; wherein PEP5 is a peptide of formula PEP3-$AA^{11}$-$AA^{12}$; wherein PEP3 is selected from the group consisting of VPT, APT, VPQ, VSQ and TQV; wherein $AA^{11}$ is selected from the group consisting of E, K, Q, R, A, D, G and H, in particular E, K, Q, A and D; wherein $AA^{12}$ is selected from the group consisting of L, M, T, E, Q and H, in particular L; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably C, S, T or R; wherein $AA^7$ is selected from the group consisting of S, T, C, E, Q, P and R, preferably is selected from the group consisting of C, S and P. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), ASAAPXXVPQAL (SEQ ID NO: 6468), ASASPXXVSQDL (SEQ ID NO: 6478), ASASPXXVPQDL (SEQ ID NO: 6476) and RNVQXRPTQVQL (SEQ ID NO: 6548).

In certain embodiments useful for inducing differentiation of mensenchymal or progenitor stem cells from the bone cell lineage, regenerating bone tissues, repairing bone and protecting from osteoporosis, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of SAIS (SEQ ID NO: 6360), NAIS (SEQ ID NO: 6357), SATS (SEQ ID NO: 6361) and SPIS (SEQ ID NO: 6364).

In certain embodiments useful for inducing differentiation of mensenchymal or progenitor stem cells from the bone cell lineage, regenerating bone tissues, repairing bone and protecting from osteoporosis, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H and Y (in particular is an aromatic, polar amino acid such as Y); wherein $AA^{20}$ is selected from the group consisting of L, F, Y, K, I, V and M, in particular is selected from the group consisting of L, F, Y, and K. In one particular example, PEP11 is selected from the group consisting of LYL, LYF, LYY and LYK.

In certain embodiments useful for inducing differentiation of mensenchymal or progenitor stem cells from the bone cell lineage, regenerating bone tissues, repairing bone and protecting from osteoporosis, PEP1 is selected from the group consisting of SAIS (SEQ ID NO: 6360), NAIS (SEQ ID NO: 6357), SATS (SEQ ID NO: 6361) and SPIS (SEQ ID NO: 6364); PEP11 is selected from the group consisting of LYL, LFF, LYF, LYY, LYK, LYI, LFI, LYV, VYY, QIM, AKV and RKI; and the pair PEP1:PEP11 is selected from the group consisting of SAIS (SEQ ID NO: 6360):LYL, NAIS (SEQ ID NO: 6357):LYF, SATS (SEQ ID NO: 6361):LYY and SPIS (SEQ ID NO: 6364):LYK.

The definitions of "PEP" pairs and triplets e.g. PEP3: PEP1, PEP5:PEP12, or PEP7:PEP5:PEP1, most particularly useful for inducing differentiation of mensenchymal or progenitor stem cells from the bone cell lineage, regenerating bone tissues, repairing bone and protecting from osteoporosis, are as already defined herein to the extent that PEP1, PEP3, PEP5, PEP7, PEP9, PEP11 and PEP12 are particularly useful for these applications as defined in the present bone section.

In certain embodiments useful for inducing differentiation of mensenchymal or progenitor stem cells from the bone cell lineage, regenerating bone tissues, repairing bone and protecting from osteoporosis, said GFR-binding compound is a synthetic molecule as defined herein in the definition section.

In certain embodiments useful for inducing differentiation of mensenchymal or progenitor stem cells from the bone cell lineage, regenerating bone tissues, repairing bone and protecting from osteoporosis, said GFR-binding compound is a synthetic peptide, or a variant or analog thereof, or a peptidomimetic.

Cartilage Certain embodiments of the invention are particularly useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis.

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP1 is selected from the group consisting of SAIS (SEQ ID NO: 6360), NAIS (SEQ ID NO: 6357), SPIS (SEQ ID NO: 6364), EPLP (SEQ ID NO: 6354) and EPLT (SEQ ID NO: 6355).

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP3 is selected from the group consisting of VPT, APT, VPQ and VSQ.

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP5 is a peptide of general formula PEP3-$AA^{11}$-$AA^{12}$; wherein PEP3 is selected from the group consisting of VPT, APT, VPQ and VSQ; wherein $AA^{11}$ is selected from the group consisting of E, K, Q, R, A, D, G and H, in particular E, K, Q, R, A and D; wherein $AA^{12}$ is selected from the group consisting of L, M, T, E, Q and H, in particular is L. In one particular example, PEP5 is selected from the group consisting of VPTEL (SEQ ID NO: 6421), APTKL (SEQ ID NO: 6369), APTQL (SEQ ID NO: 6372), VPTRL (SEQ ID NO: 6427), VPQAL (SEQ ID NO: 6410), VSQDL (SEQ ID NO: 6429) and VPQDL (SEQ ID NO: 6411).

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S, C or T; wherein $AA^7$ is absent or is selected from the group consisting of S, T, C, E, Q, P and R, preferably is S or C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), STPPTXX (SEQ ID NO: 6452), ASAAPXX (SEQ ID NO: 6437) and ASASPXX (SEQ ID NO: 6438).

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, VPQ and VSQ; wherein $AA^{11}$ is selected from the group consisting of E, K, Q, R, A, D, G and H, in particular E, K, Q, R, A and D; wherein $AA^{12}$ is selected from the group consisting of L, M, T, E, Q and H, in particular is L; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S, C or T; wherein $AA^7$ is selected from the group consisting of S, T, C, E, Q, P and R, preferably is S or C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), STPPTXXVPTRL (SEQ ID NO: 6573), ASAAPXXVPQAL (SEQ ID NO: 6468), ASASPXXVSQDL (SEQ ID NO: 6478) and ASASPXXVPQDL (SEQ ID NO: 6476).

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of SAIS (SEQ ID NO: 6360), NAIS (SEQ ID NO: 6357), SPIS (SEQ ID NO: 6364), EPLP (SEQ ID NO: 6354) and EPLT (SEQ ID NO: 6355).

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP11 is a peptide with 3 amino acids of general formula $AA^{18}$-$AA^{19}$-$AA^{20}$; wherein $AA^{18}$ is selected from the group consisting of L, V, Q, A and R, in particular is L or V; wherein $AA^{19}$ is selected from the group consisting of F, W, H and Y, in particular is Y or F; wherein $AA^{20}$ is selected from the group consisting of L, F, Y and I. In one particular example, PEP11 is selected from the group consisting of LYL, LYF, LFI, VYY and LYY.

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, PEP1 is selected from the group consisting of SAIS (SEQ ID NO: 6360), NAIS (SEQ ID NO: 6357), SPIS (SEQ ID NO: 6364), EPLP (SEQ ID NO: 6354) and EPLT (SEQ ID NO: 6355); PEP11 is selected from the group consisting of LYL, LYF, LFI, VYY and LYY; and the pair PEP1:PEP11 is selected from the group consisting of SAIS (SEQ ID NO: 6360):LYL, NAIS (SEQ ID NO: 6357):LYF, SPIS (SEQ ID NO: 6364):LFI, EPLP (SEQ ID NO: 6354): VYY and EPLT (SEQ ID NO: 6355):LYY.

The definitions of "PEP" pairs and triplets e.g. PEP3: PEP1, PEP5:PEP12, or PEP7:PEP5:PEP1, most particularly useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, are as already defined herein to the extent that PEP1, PEP3, PEP5, PEP7, PEP9, PEP11 and PEP12 are particularly useful for these applications as defined in the present cartilage section.

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, said GFR-binding compound is a synthetic molecule as defined herein in the definition section.

In certain embodiments useful for inducing differentiation of mensenchymal or progenitor stem cells from the cartilage cell lineage, regenerating cartilage tissues, repairing cartilage and protecting from, for instance, osteoarthritis, costochondritis, Herniation, achondroplasia or relapsing polychondritis, said GFR-binding compound is a synthetic peptide, or a variant or analog thereof, or a peptidomimetic.

Vascular Tissues

Certain embodiments of the invention are particularly useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies.

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP1 is selected from the group consisting of SNIT (SEQ ID NO: 6362), RPVQ (SEQ ID NO: 6358) and RSVK (SEQ ID NO: 6359).

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP3 is selected from the group consisting of VPT, SRV and TQV.

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP5 is a peptide of general formula PEP3-$AA^{11}$-$AA^{12}$; wherein PEP3 is selected from the group consisting of VPT, SRV and TQV; wherein $AA^{11}$ is selected from the group consisting of E, K, Q, R, A, D, G and H, in particular is E, G, H and Q; wherein $AA^{12}$ is selected from the group consisting of L, M, T, E, Q and H, in particular is selected from the group consisting of E, Q, H and L. In one particular example, PEP5 is selected from the group consisting of VPTGQ (SEQ ID NO: 6422), VPTEE (SEQ ID NO: 6420), SRVHH (SEQ ID NO: 6382) and TQVQL (SEQ ID NO: 6393).

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of E, Q and R; wherein $AA^7$ is absent or is selected from the group consisting of S, T, C, E, Q, P and R, preferably is selected from the group consisting of S, C and P; and wherein at least one of $AA^1$, $AA^2$, $AA^3$, $AA^4$, $AA^5$, $AA^6$ or $AA^7$ is not absent. In one particular example, PEP7 is selected from the group consisting of NDEGLEX (SEQ ID NO: 6447), SSVKXQP (SEQ ID NO: 6451) and RNVQXRP (SEQ ID NO: 6448).

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, SRV and TQV; wherein $AA^{11}$ is selected from the group consisting of E, K, Q, R, A, D, G and H, in particular is E, G, H and Q; wherein $AA^{12}$ is selected from the group consisting of L, M, T, E, Q and H, in particular is selected from the group consisting of E, Q, H and L; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of E, Q and R; wherein $AA^7$ is selected from the group consisting of S, T, C, E, Q, P and R, preferably is selected from the group consisting of S, C and P. In one particular example, PEP9 is selected from the group consisting of NDEGLEXVPTEE (SEQ ID NO: 6545), NDEGLEXVPTGQ (SEQ ID NO: 6546), SSVKXQPSRVHH (SEQ ID NO: 6565) and RNVQXRPTQVQL (SEQ ID NO: 6548).

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of SNIT (SEQ ID NO: 6362), RPVQ (SEQ ID NO: 6358) and RSVK (SEQ ID NO: 6359).

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP11 is a peptide with 3 amino acids of general formula $AA^{18}$-$AA^{19}$-$AA^{20}$; wherein $AA^{18}$ is selected from the group consisting of L, V, Q, A and R, in particular is selected from the group consisting of Q, A and R; wherein $AA^{19}$ is selected from the group consisting of F, W, H, Y, I and K, in particular is I or K; wherein $AA^{20}$ is selected from the group consisting of L, F, Y, K, I, V and M, in particular is selected from the group consisting of M, V and I. In one particular example, PEP11 is selected from the group consisting of QIM, AKV and RKI.

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, PEP1 is selected from the group consisting of SNIT (SEQ ID NO: 6362), RPVQ (SEQ ID NO: 6358) and RSVK (SEQ ID NO: 6359); PEP11 is selected from the group consisting of QIM, AKV and RKI; and the pair PEP1:PEP11 is selected from the group consisting of SNIT (SEQ ID NO: 6362):QIM, RSVK (SEQ ID NO: 6359):KEVQV and RPVQ (SEQ ID NO: 6358):KKATV.

The definitions of "PEP" pairs and triplets e.g. PEP3:PEP1, PEP5:PEP12, or PEP7:PEP5:PEP1, most particularly useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, are as already defined herein to the extent that PEP1, PEP3, PEP5, PEP7, PEP9, PEP11 and PEP12 are particularly useful for these applications as defined in the present vascular tissue section.

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, said GFR-binding compound is a synthetic molecule as defined herein in the definition section.

In other embodiments useful for inducing differentiation of mensenchymal or progenitor stem cells from the vascular cell lineage, enhancing of endothelization, vascularization/angiogenesis, protecting a subject from heart tissue degeneration-related diseases, disorders, conditions or pathologies, said GFR-binding compound is a synthetic peptide, or a variant or analog thereof, or a peptidomimetic.

Neuroregeneration

Certain embodiments of the invention are particularly useful for inducing differentiation of mensenchymal or progenitor stem cells from the neuronal cell lineage, promoting neuron-regeneration, and protecting from neuron degeneration-related conditions and diseases.

In certain embodiments useful for inducing differentiation of mensenchymal or progenitor stem cells from the neuronal cell lineage, promoting neuron-regeneration, and protecting from neuron degeneration-related conditions and diseases, PEP1 is selected from the group consisting of NAIS (SEQ ID NO: 6357), SPIS (SEQ ID NO: 6364) and EPIS (SEQ ID NO: 6353).

In certain embodiments useful for inducing differentiation of mensenchymal or progenitor stem cells from the neuronal cell lineage, promoting neuron-regeneration, and protecting from neuron degeneration-related conditions and diseases, PEP3 is selected from the group consisting of VPT, APT, VPA, VPQ and VSQ.

In certain embodiments useful for inducing differentiation of mensenchymal or progenitor stem cells from the neuronal cell lineage, promoting neuron-regeneration, and protecting from neuron degeneration-related conditions and diseases, PEP5 is a peptide of general formula PEP3-$AA^{11}$-$AA^{12}$; wherein PEP3 is selected from the group consisting of VPT, APT, VPA, VPQ and VSQ; wherein $AA^{11}$ is selected from the group consisting of E, K, Q, R, A, D, G and H, in particular E, K, Q, R, A and D; wherein $AA^{12}$ is selected from the group consisting of L, M, T, E, Q and H, in particular L. In one particular example, PEP5 is selected from the group consisting of VPTEL (SEQ ID NO: 6421), APTKL (SEQ ID NO: 6369), APTQL (SEQ ID NO: 6372), VPTKL (SEQ ID NO: 6423), VPARL (SEQ ID NO: 6401), VPQAL (SEQ ID NO: 6410), VSQDL (SEQ ID NO: 6429) and VPQDL (SEQ ID NO: 6411).

In certain embodiments useful for inducing differentiation of mensenchymal or progenitor stem cells from the neuronal cell lineage, promoting neuron-regeneration, and protecting from neuron degeneration-related conditions and diseases, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA'$ as defined herein; wherein $AA^6$ is absent or selected from the group consisting of S, T, C, E, Q, P and R, preferably S or C; wherein $AA^7$ is absent or is selected from the group consisting of S, T, C, E, Q, P and R, preferably is S or C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), ASAAPXX (SEQ ID NO: 6437), ASASPXX (SEQ ID NO: 6438) and RNVQXRP (SEQ ID NO: 6448).

In certain embodiments useful for inducing differentiation of mensenchymal or progenitor stem cells from the neuronal cell lineage, promoting neuron-regeneration, and protecting from neuron degeneration-related conditions and diseases, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, VPA, VPQ and VSQ; wherein $AA^{11}$ is selected from the group consisting of E, K, Q, R, A, D, G and H, in particular E, K, Q, R, A and D; wherein $AA^{12}$ is selected from the group consisting of L, M, T, E, Q and H, in particular L; wherein $AA^1$, $AA^2$, $AA^3$, $AA^4$, and $AA^5$ are independently absent or $AA'$ as defined herein; wherein $AA^6$ is absent or selected from the group consisting of S, T, C, E, Q, P and R, preferably S or C; wherein $AA^7$ is selected from the group consisting of S, T, C, E, Q, P and R, preferably is S or C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), ASAAPXXVPQAL (SEQ ID NO: 6468), ASASPXXVSQDL (SEQ ID NO: 6478), ASASPXXVPQDL (SEQ ID NO: 6476) and RNVQXRPTQVQL (SEQ ID NO: 6548).

In certain embodiments useful for inducing differentiation of mensenchymal or progenitor stem cells from the neuronal cell lineage, promoting neuron-regeneration, and protecting from neuron degeneration-related conditions and diseases, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of NAIS (SEQ ID NO: 6357), SPIS (SEQ ID NO: 6364) and EPIS (SEQ ID NO: 6353).

In certain embodiments useful for inducing differentiation of mensenchymal or progenitor stem cells from the neuronal cell lineage, promoting neuron-regeneration, and protecting from neuron degeneration-related conditions and diseases, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H and Y (in particular is an aromatic, polar amino acid such as Y); wherein $AA^{20}$ is selected from the group consisting of L, F, Y, K, I, V and M, in particular is selected from the group consisting of L, F, I, and K. In one particular example, PEP11 is selected from the group consisting of LYL, LYF, LYI and LYK.

In certain embodiments useful for inducing differentiation of mensenchymal or progenitor stem cells from the neuronal cell lineage, promoting neuron-regeneration, and protecting from neuron degeneration-related conditions and diseases, PEP1 is selected from the group consisting of NAIS (SEQ ID NO: 6357), SPIS (SEQ ID NO: 6364) and EPIS (SEQ ID NO: 6353); PEP11 is selected from the group consisting of LYF, LYK, LYL and LYI; and the pair PEP1:PEP11 is selected from the group consisting of NAIS (SEQ ID NO: 6357):LYF, SPIS (SEQ ID NO: 6364):LYK, EPIS (SEQ ID NO: 6353):LYL and SPIS (SEQ ID NO: 6364):LYI.

The definitions of "PEP" pairs and triplets e.g. PEP3:PEP1, PEP5:PEP12, or PEP7:PEP5:PEP1, most particularly useful for inducing differentiation of mensenchymal or progenitor stem cells from the neuronal cell lineage, promoting neuron-regeneration, and protecting from neuron degeneration-related conditions and diseases, are as already defined herein to the extent that PEP1, PEP3, PEP5, PEP7, PEP9, PEP11 and PEP12 are particularly useful for these applications as defined in the present neuroregeneration section.

In certain embodiments useful for inducing differentiation of mensenchymal or progenitor stem cells from the neuronal cell lineage, promoting neuron-regeneration, and protecting from neuron degeneration-related conditions and diseases, said GFR-binding compound is a synthetic molecule as defined herein in the definition section.

In certain embodiments useful for inducing differentiation of mensenchymal or progenitor stem cells from the neuronal cell lineage, promoting neuron-regeneration, and protecting from neuron degeneration-related conditions and diseases, said GFR-binding compound is a synthetic peptide, or a variant or analog thereof, or a peptidomimetic.

Eye Retina

Certain embodiments of the invention are particularly useful for inducing differentiation of mensenchymal or progenitor stem cells from the retinal cell lineage, promoting eye retina cell regeneration and protecting from eye retina cell degeneration-related conditions or diseases such as macular degeneration.

In certain embodiments useful for inducing differentiation of mensenchymal or progenitor stem cells from the retinal cell lineage, promoting eye retina cell regeneration and protecting from eye retina cell degeneration-related conditions or diseases, PEP1 is SPIN (SEQ ID NO: 6363).

In certain embodiments useful for inducing differentiation of mensenchymal or progenitor stem cells from the retinal cell lineage, promoting eye retina cell regeneration and protecting from eye retina cell degeneration-related conditions or diseases, PEP3 is selected from the group consisting of VPT, APT, TPT, VPA and APV.

In certain embodiments useful for inducing differentiation of mensenchymal or progenitor stem cells from the retinal cell lineage, promoting eye retina cell regeneration and protecting from eye retina cell degeneration-related conditions or diseases, PEP5 is a peptide of general formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is E, K, Q and R; wherein AA12 is selected from the group consisting of L, M, T, E, Q and H, in particular is L, M or T. In one particular example, PEP5 is selected from the group consisting of VPTEL (SEQ ID NO: 6421), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427) and APVKT (SEQ ID NO: 6379).

In certain embodiments useful for inducing differentiation of mensenchymal or progenitor stem cells from the retinal cell lineage, promoting eye retina cell regeneration and protecting from eye retina cell degeneration-related conditions or diseases, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S or C; wherein $AA^7$ is absent or is selected from the group consisting of S, T, C, E, Q, P and R, preferably is S or C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPAXXS, STPPTXX (SEQ ID NO: 6452), HVPKPXX (SEQ ID NO: 6442) and RVPSTXX (SEQ ID NO: 6449).

In certain embodiments useful for inducing differentiation of mensenchymal or progenitor stem cells from the retinal cell lineage, promoting eye retina cell regeneration and protecting from eye retina cell degeneration-related conditions or diseases, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is E, K, Q and R; wherein $AA^{12}$ is selected from the group consisting of L, M, T, E, Q and H, in particular is L, M or T; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S or C; wherein $AA^7$ is absent from the group consisting of S, T, C, E, Q, P and R, preferably is S or C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXX (SEQ ID NO: 6441)TPTKL (SEQ ID NO: 6387), AAPASXXVPARL (SEQ ID NO: 6458), STPPTXXVPTRL (SEQ ID NO: 6573), HVPKPXXAPTKL (SEQ ID NO: 6503) and RVPSTXXAPVKT (SEQ ID NO: 6550).

In certain embodiments useful for inducing differentiation of mensenchymal or progenitor stem cells from the retinal cell lineage, promoting eye retina cell regeneration and protecting from eye retina cell degeneration-related conditions or diseases, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is SPIN (SEQ ID NO: 6363).

In certain embodiments useful for inducing differentiation of mensenchymal or progenitor stem cells from the retinal cell lineage, promoting eye retina cell regeneration and protecting from eye retina cell degeneration-related conditions or diseases, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H and Y, in particular is Y or F; wherein $AA^{20}$ is selected from the group consisting of L, F, Y, K, I, V and M, in particular is selected from the group consisting of L, F, Y, K, I and V. In one particular example, PEP11 is LYF.

In certain embodiments useful for inducing differentiation of mensenchymal or progenitor stem cells from the retinal cell lineage, promoting eye retina cell regeneration and protecting from eye retina cell degeneration-related conditions or diseases, PEP1 is SPIN (SEQ ID NO: 6363) and PEP11 is LYF.

The definitions of "PEP" pairs and triplets e.g. PEP3:PEP1, PEP5:PEP12, or PEP7:PEP5:PEP1, most particularly useful for inducing differentiation of mensenchymal or progenitor stem cells from the retinal cell lineage, promoting eye retina cell regeneration and protecting from eye retina cell degeneration-related conditions or diseases, are as already defined herein to the extent that PEP1, PEP3, PEP5, PEP7, PEP9, PEP11 and PEP12 are particularly useful for these applications as defined in the present eye retina section.

In certain embodiments useful for inducing differentiation of mensenchymal or progenitor stem cells from the retinal cell lineage, promoting eye retina cell regeneration and protecting from eye retina cell degeneration-related conditions or diseases, said GFR-binding compound is a synthetic molecule as defined herein in the definition section.

In certain embodiments useful for inducing differentiation of mensenchymal or progenitor stem cells from the retinal cell lineage, promoting eye retina cell regeneration and protecting from eye retina cell degeneration-related conditions or diseases, said GFR-binding compound is a synthetic peptide, or a variant or analog thereof, or a peptidomimetic.

Renal Tissues Certain embodiments of the invention are particularly useful for inducing differentiation of mensenchymal or progenitor stem cells from the renal cell lineage, promoting renal cell regeneration and/or renal functions and protecting from renal cell degeneration-related conditions or diseases such as chronic kidney disease or renal fibrosis.

In certain embodiments useful for inducing differentiation of mensenchymal or progenitor stem cells from the renal cell lineage, promoting renal cell regeneration and/or renal functions and protecting from renal cell degeneration-related conditions or diseases, PEP1 is SPIN (SEQ ID NO: 6363).

In certain embodiments useful for inducing differentiation of mensenchymal or progenitor stem cells from the renal cell lineage, promoting renal cell regeneration and/or renal functions and protecting from renal cell degeneration-related conditions or diseases, PEP3 is selected from the group consisting of VPT, APT, TPT, VPA and APV.

In certain embodiments useful for inducing differentiation of mensenchymal or progenitor stem cells from the renal cell lineage, promoting renal cell regeneration and/or renal functions and protecting from renal cell degeneration-related conditions or diseases, PEP5 is a peptide of general formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is E, K, Q and R; wherein $AA^{12}$ is selected from the group consisting of L, M, T, E, Q and H, in particular is L, M or T. In one particular example, PEP5 is selected from the group consisting of VPTEL (SEQ ID NO: 6421), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427) and APVKT (SEQ ID NO: 6379).

In certain embodiments useful for inducing differentiation of mensenchymal or progenitor stem cells from the renal cell lineage, promoting renal cell regeneration and/or renal functions and protecting from renal cell degeneration-related conditions or diseases, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S or C; wherein $AA^7$ is absent or is selected from the group consisting of S, T, C, E, Q, P and R, preferably is S or C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPAXXS, STPPTXX (SEQ ID NO: 6452), HVPKPXX (SEQ ID NO: 6442) and RVPSTXX (SEQ ID NO: 6449).

In certain embodiments useful for inducing differentiation of mensenchymal or progenitor stem cells from the renal cell lineage, promoting renal cell regeneration and/or renal functions and protecting from renal cell degeneration-related conditions or diseases, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is E, K, Q and R; wherein $AA^{12}$ is selected from the group consisting of L, M, T, E, Q and H, in particular is L, M or T; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S or C; wherein $AA^7$ is selected from the group consisting of S, T, C, E, Q, P and R, preferably is S or C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXX (SEQ ID NO: 6441)TPTKL (SEQ ID NO: 6387), AAPASXXVPARL (SEQ ID NO: 6458), STPPTXXVPTRL (SEQ ID NO: 6573), HVPKPXXAPTKL (SEQ ID NO: 6503) and RVPSTXXAPVKT (SEQ ID NO: 6550).

In certain embodiments useful for inducing differentiation of mensenchymal or progenitor stem cells from the renal cell lineage, promoting renal cell regeneration and/or renal functions and protecting from renal cell degeneration-related conditions or diseases, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is SPIN (SEQ ID NO: 6363).

In certain embodiments useful for inducing differentiation of mensenchymal or progenitor stem cells from the renal cell lineage, promoting renal cell regeneration and/or renal functions and protecting from renal cell degeneration-related conditions or diseases, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H and Y, in particular is Y or F; wherein $AA^{20}$ is selected from the group consisting of L, F, Y, K, I, V and M, in particular is selected from the group consisting of L, F, Y, K, I and V. In one particular example, PEP11 is LYF.

In certain embodiments useful for inducing differentiation of mensenchymal or progenitor stem cells from the renal cell lineage, promoting renal cell regeneration and/or renal functions and protecting from renal cell degeneration-related conditions or diseases, PEP1 is SPIN (SEQ ID NO: 6363) and PEP11 is LYF.

The definitions of "PEP" pairs and triplets e.g. PEP3:PEP1, PEP5:PEP12, or PEP7:PEP5:PEP1, most particularly useful for inducing differentiation of mensenchymal or progenitor stem cells from the renal cell lineage, promoting renal cell regeneration and/or renal functions and protecting from renal cell degeneration-related conditions or diseases, are as already defined herein to the extent that PEP1, PEP3, PEP5, PEP7, PEP9, PEP11 and PEP12 are particularly useful for these applications as defined in the present renal tissue section.

In certain embodiments useful for inducing differentiation of mensenchymal or progenitor stem cells from the renal cell lineage, promoting renal cell regeneration and/or renal functions and protecting from renal cell degeneration-related conditions or diseases, said GFR-binding compound is a synthetic molecule as defined herein in the definition section.

In certain embodiments useful for inducing differentiation of mensenchymal or progenitor stem cells from the renal cell lineage, promoting renal cell regeneration and/or renal functions and protecting from renal cell degeneration-related conditions or diseases, said GFR-binding compound is a synthetic peptide, or a variant or analog thereof, or a peptidomimetic.

Ligaments and Tendons

Certain embodiments of the invention are particularly useful for inducing differentiation of mensenchymal or progenitor stem cells from the ligament and tendon (UT) cell lineage, promoting fibrous tissue formation and T/L regeneration and protecting from UT cell degeneration and L/T cell degeneration-related diseases, conditions, disorders or pathologies.

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP1 is selected from the group consisting of NAIS (SEQ ID NO: 6357), SPIS (SEQ ID NO: 6364), EPLP (SEQ ID NO: 6354) and EPLT (SEQ ID NO: 6355).

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP3 is selected from the group consisting of VPT, APT, VPQ and VSQ.

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP5 is a peptide of general formula PEP3-$AA^{11}$-$AA^{12}$; wherein PEP3 is selected from the group consisting of VPT, APT, VPQ and VSQ; wherein $AA^{11}$ is selected from the group consisting of E, K, Q, R, A, D, G and H, in particular is E, K, Q, R, A and D; wherein $AA^{12}$ is selected from the group consisting of L, M, T, E, Q and H, in particular is L. In one particular example, PEP5 is selected from the group consisting of VPTEL (SEQ ID NO: 6421), APTKL (SEQ ID NO: 6369), APTQL (SEQ ID NO: 6372), VPTRL (SEQ ID NO: 6427), VPQAL (SEQ ID NO: 6410), VSQDL (SEQ ID NO: 6429) and VPQDL (SEQ ID NO: 6411).

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of T, S and C; wherein $AA^7$ is absent or is selected from the group consisting of S, T, C, E, Q, P and R, preferably S or C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), STPPTXX (SEQ ID NO: 6452), ASAAPXX (SEQ ID NO: 6437) and ASASPXX (SEQ ID NO: 6438).

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP5 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, VPQ and VSQ; wherein $AA^{11}$ is selected from the group consisting of E, K, Q, R, A, D, G and H, in particular is E, K, Q, R, A and D; wherein $AA^{12}$ is selected from the group consisting of L, M, T, E, Q and H, in particular is L; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of T, S and C; wherein $AA^7$ is selected from the group consisting of S, T, C, E, Q, P and R, preferably S or C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), STPPTXXVPTRL (SEQ ID NO: 6573), ASAAPXXVPQAL (SEQ ID NO: 6468), ASASPXXVSQDL (SEQ ID NO: 6478) and ASASPXXVPQDL (SEQ ID NO: 6476).

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of NAIS (SEQ ID NO: 6357), SPIS (SEQ ID NO: 6364), EPLP (SEQ ID NO: 6354) and EPLT (SEQ ID NO: 6355).

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP11 is a peptide with 3 amino acids of general formula $AA^{18}$-$AA^{19}$-$AA^{20}$; wherein $AA^{18}$ is selected from the group consisting of L, V, Q, A and R, in particular is L or V; wherein $AA^{19}$ is selected from the group consisting of F, W, H and Y, in particular is Y or F; wherein $AA^{20}$ is selected from the group consisting of L, F, Y, K, I, V and M, in particular is selected from the group consisting of F, I and Y. In one particular example, PEP11 is selected from the group consisting of LYF, LFI, VYY and LYY.

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP1 is selected from the group consisting of NAIS (SEQ ID NO: 6357), SPIS (SEQ ID NO: 6364), EPLP (SEQ ID NO: 6354) and EPLT (SEQ ID NO: 6355); PEP11 is selected from the group consisting of LYF, LFI, VYY and LYY; and the pair PEP1:PEP11 is selected from the group consisting of NAIS (SEQ ID NO: 6357):LYF, SPIS (SEQ ID NO: 6364):LFI, EPLP (SEQ ID NO: 6354):VYY and EPLT (SEQ ID NO: 6355):LYY.

The definitions of "PEP" pairs and triplets e.g. PEP3:PEP1, PEP5:PEP12, or PEP7:PEP5:PEP1, most particularly useful for inducing differentiation of mensenchymal or progenitor stem cells from the ligament and tendon (L/T) cell lineage, promoting fibrous tissue formation and T/L regeneration and protecting from UT cell degeneration and L/T cell degeneration-related diseases, conditions, disorders or pathologies, are as already defined herein to the extent that PEP1, PEP3, PEP5, PEP7, PEP9, PEP11 and PEP12 are particularly useful for these applications as defined in the present L/T section.

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, said GFR-binding compound is a synthetic molecule as defined herein in the definition section.

In certain embodiments useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, said GFR-binding compound is a synthetic peptide, or a variant or analog thereof, or a peptidomimetic.

In other embodiments also useful for inducing differentiation of mensenchymal or progenitor stem cells from the ligament and tendon (LIT) cell lineage, promoting fibrous tissue formation and T/L regeneration and protecting from L/T cell degeneration and L/T cell degeneration-related diseases, conditions, disorders or pathologies, PEP1 is SPIS (SEQ ID NO: 6364).

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP3 is selected from the group consisting of VPT, APT, TPT, VPA and APV.

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP5 is a peptide of general formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is selected from the group consisting of E, K, Q and R; wherein $AA^{12}$ is selected from the group consisting of L, M, T, E, Q and H, in particular is selected from the group consisting of L, M and T. In one particular example, PEP5 is selected from the group consisting of VPTEL (SEQ ID NO: 6421), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427) and APVKT (SEQ ID NO: 6379).

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S or C; wherein $AA^7$ is absent or is selected from the group consisting of S, T, C, E, Q, P and R, preferably is S or C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPAXXS, STPPTXX (SEQ ID NO: 6452), HVPKPXX (SEQ ID NO: 6442) and RVPSTXX (SEQ ID NO: 6449).

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is E, K, Q and R; wherein $AA^{12}$ is selected from the group consisting of L, M, T, E, Q and H, in particular is L, M or T; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is S or C; wherein $AA^7$ is selected from the group consisting of S, T, C, E, Q, P and R, preferably is S or C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXX (SEQ ID NO: 6441)TPTKL (SEQ ID NO: 6387), AAPASXXVPARL (SEQ ID NO: 6458), STPPTXXVPTRL (SEQ ID NO: 6573), HVPKPXXAPTKL (SEQ ID NO: 6503) and RVPSTXXAPVKT (SEQ ID NO: 6550).

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is SPIS (SEQ ID NO: 6364).

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H and Y, in particular is a polar aromatic amino acid such as Y; wherein $AA^{20}$ is selected from the group consisting of L, F, Y, K, I, V and M, in particular is I. In one particular example, PEP11 is LYI.

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, PEP1 is SPIS (SEQ ID NO: 6364) and PEP11 is LYI.

The definitions of "PEP" pairs and triplets e.g. PEP3: PEP1, PEP5:PEP12, or PEP7:PEP5:PEP1, also most particularly useful for inducing differentiation of mensenchymal or progenitor stem cells from the ligament and tendon (L/T) cell lineage, promoting fibrous tissue formation and T/L regeneration and protecting from UT cell degeneration and L/T cell degeneration-related diseases, conditions, disorders or pathologies, are as already defined herein to the extent that PEP1, PEP3, PEP5, PEP7, PEP9, PEP11 and PEP12 are particularly useful for these applications as defined in the present UT section.

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, said GFR-binding compound is a synthetic molecule as defined herein in the definition section.

In other embodiments also useful for inducing differentiation of mensenchymal or progenitor stem cells from the ligament and tendon (L/T) cell lineage, promoting fibrous tissue formation and T/L regeneration and protecting from L/T cell degeneration and L/T cell degeneration-related diseases, conditions, disorders or pathologies, said GFR-binding compound is a synthetic peptide, or a variant or analog thereof, or a peptidomimetic.

Wound Healing

Certain embodiments of the invention are particularly useful for inducing differentiation of mensenchymal or progenitor stem cells involved in the process of wound healing as defined herein, promoting wound healing, skin repair and cellular migration.

In certain embodiments useful for inducing differentiation of mensenchymal or progenitor stem cells involved in the process of wound healing as defined herein, promoting wound healing, skin repair and cellular migration, PEP1 is selected from the group consisting of SNIT (SEQ ID NO: 6362), RPVQ (SEQ ID NO: 6358) and RSVK (SEQ ID NO: 6359).

In certain embodiments useful for inducing differentiation of mensenchymal or progenitor stem cells involved in the process of wound healing as defined herein, promoting wound healing, skin repair and cellular migration, PEP3 is selected from the group consisting of VPT, SRV and TQV.

In certain embodiments useful for inducing differentiation of mensenchymal or progenitor stem cells involved in the process of wound healing as defined herein, promoting wound healing, skin repair and cellular migration, PEP5 is a peptide of general formula PEP3-$AA^{11}$-$AA^{12}$; wherein PEP3 is selected from the group consisting of VPT, SRV and TQV; wherein $AA^{11}$ is selected from the group consisting of E, K, Q, R, A, D, G and H, in particular is selected from the group consisting of E, G, H and Q; wherein $AA^{12}$ is selected from the group consisting of L, M, T, E, Q and H, in particular is selected from the group consisting of E, Q, H and L. In one particular example, PEP5 is selected from the group consisting of VPTGQ (SEQ ID NO: 6422), VPTEE (SEQ ID NO: 6420), SRVHH (SEQ ID NO: 6382) and TQVQL (SEQ ID NO: 6393).

In certain embodiments useful for inducing differentiation of mensenchymal or progenitor stem cells involved in the process of wound healing as defined herein, promoting wound healing, skin repair and cellular migration, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of E, Q and R; wherein $AA^7$ is absent or is selected from the group consisting of S, T, C, E, Q, P and R, preferably is selected from the group consisting of S, C and P; and wherein at least one of $AA^1$, $AA^2$, $AA^3$, $AA^4$, $AA^5$, $AA^6$ or $AA^7$ is not absent. In one particular example, PEP7 is selected from the group consisting of NDEGLEX (SEQ ID NO: 6447), SSVKXQP (SEQ ID NO: 6451) and RNVQXRP (SEQ ID NO: 6448).

In certain embodiments useful for inducing differentiation of mensenchymal or progenitor stem cells involved in the process of wound healing as defined herein, promoting wound healing, skin repair and cellular migration, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, SRV and TQV; wherein $AA^{11}$ is selected from the group consisting of E, K, Q, R, A, D, G and H, in particular is E, G, H and Q; wherein $AA^{12}$ is selected from the group consisting of L, M, T, E, Q and H, in particular is selected from the group consisting of E, Q, H and L; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of E, Q and R; wherein $AA^7$ is selected from the group consisting of S, T, C, E, Q, P and R, preferably is selected from the group consisting of S, C and P. In one particular example, PEP9 is selected from the group consisting of NDEGLEXVPTEE (SEQ ID NO: 6545), NDEGLEXVPTGQ (SEQ ID NO: 6546), SSVKXQPSRVHH (SEQ ID NO: 6565) and RNVQXRPTQVQL (SEQ ID NO: 6548).

In certain embodiments useful for inducing differentiation of mensenchymal or progenitor stem cells involved in the process of wound healing as defined herein, promoting wound healing, skin repair and cellular migration, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of SNIT (SEQ ID NO: 6362), RPVQ (SEQ ID NO: 6358) and RSVK (SEQ ID NO: 6359).

In certain embodiments useful for inducing differentiation of mensenchymal or progenitor stem cells involved in the process of wound healing as defined herein, promoting wound healing, skin repair and cellular migration, PEP11 is a peptide with 3 amino acids of general formula $AA^{18}$-$AA^{19}$-$AA^{20}$; wherein AA18 is selected from the group consisting of L, V, Q, A and R, in particular is selected from the group consisting of Q, A and R; wherein $AA^{19}$ is selected from the group consisting of F, W, H, Y, I and K, in particular is I or K; wherein $AA^{20}$ is selected from the group consisting of L, F, Y, K, I, V and M, in particular is selected from the group consisting of M, V and I. In one particular example, PEP11 is selected from the group consisting of QIM, AKV and RKI.

In certain embodiments useful for inducing differentiation of mensenchymal or progenitor stem cells involved in the process of wound healing as defined herein, promoting wound healing, skin repair and cellular migration, PEP1 is selected from the group consisting of SNIT (SEQ ID NO: 6362), RPVQ (SEQ ID NO: 6358) and RSVK (SEQ ID NO: 6359); PEP11 is selected from the group consisting of QIM, AKV and RKI; and the pair PEP1:PEP11 is selected from the group consisting of SNIT (SEQ ID NO: 6362):QIM, RSVK (SEQ ID NO: 6359):KEVQV and RPVQ (SEQ ID NO: 6358):KKATV.

The definitions of "PEP" pairs and triplets e.g. PEP3: PEP1, PEP5:PEP12, or PEP7:PEP5:PEP1, also most particularly useful for inducing differentiation of mensenchymal or progenitor stem cells involved in the process of wound healing as defined herein, promoting wound healing, skin repair and cellular migration, are as already defined herein to the extent that PEP1, PEP3, PEP5, PEP7, PEP9, PEP11 and PEP12 are particularly useful for these applications as defined in the present wound healing section.

In certain embodiments useful for inducing differentiation of mensenchymal or progenitor stem cells involved in the process of wound healing as defined herein, promoting wound healing, skin repair and cellular migration, said GFR-binding compound is a synthetic molecule as defined herein in the definition section.

In certain embodiments useful for inducing differentiation of mensenchymal or progenitor stem cells involved in the process of wound healing as defined herein, promoting wound healing, skin repair and cellular migration, said GFR-binding compound is a synthetic peptide, or a variant or analog thereof, or a peptidomimetic.

Skin Regeneration and Anti-Aging

Certain embodiments of the invention are particularly useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies.

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP1 is selected from the group consisting of EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358).

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP3 is selected from the group consisting of VPT, APT, VPQ, VSQ, SRV and TQV.

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP5 is a peptide of general formula PEP3-$AA^{11}$-$AA^{12}$; wherein PEP3 is selected from the group consisting of VPT, APT, VPQ, VSQ, SRV and TQV; wherein $AA^{11}$ is selected from the group consisting of E, K, Q, R, A, D, G and H, in particular is selected from the group consisting of E, K, Q, A, D and H; wherein $AA^{12}$ is selected from the group consisting of L, M, T, E, Q and H, in particular is selected from the group consisting of L, E and H. In one particular example, PEP5 is selected from the group consisting of VPTEL (SEQ ID NO: 6421), APTKL (SEQ ID NO: 6369), APTQL (SEQ ID NO: 6372), VPQAL (SEQ ID NO: 6410), VSQDL (SEQ ID NO: 6429), VPQDL (SEQ ID NO: 6411), VPTEE (SEQ ID NO: 6420), SRVHH (SEQ ID NO: 6382) and TQVQL (SEQ ID NO: 6393).

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of C, S, T, E, R and Q; wherein $AA^7$ is absent or is selected from the group consisting of S, T, C, E, Q, P and R, preferably is selected from the group consisting of S, C and P; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), ASAAPXX (SEQ ID NO: 6437), ASASPXX (SEQ ID NO: 6438), NDEGLEX (SEQ ID NO: 6447), SSVKXQP (SEQ ID NO: 6451) and RNVQXRP (SEQ ID NO: 6448).

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP5 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, VPQ, VSQ, SRV and TQV; wherein $AA^{11}$ is selected from the group consisting of E, K, Q, R, A, D, G and H, in particular is selected from the group consisting of E, K, Q, A, D and H; wherein $AA^{12}$ is selected from the group consisting of L, M, T, E, Q and H, in particular is selected from the group consisting of L, E and H; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of C, S, T, E, R and Q; wherein $AA^7$ is selected from the group consisting of S, T, C, E, Q, P and R, preferably is selected from the group consisting of S, C and P. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), ASAAPXXVPQAL (SEQ ID NO: 6468), ASASPXXVSQDL (SEQ ID NO: 6478), ASASPXXVPQDL (SEQ ID NO: 6476), NDEGLEXVPTEE (SEQ ID NO: 6545), SSVKXQPSRVHH (SEQ ID NO: 6565) and RNVQXRPTQVQL (SEQ ID NO: 6548).

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP12 is a peptide of general formula PEP1-AA$^{17}$-PEP11; wherein AA$^{17}$ is selected from the group consisting of G, A, V, L, I, P, F, M, W, T and S (in particular is selected from the group consisting of M, I, L, V and T); wherein PEP1 is selected from the group consisting of EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358).

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP11 is a peptide with 3 amino acids of general formula AA$^{18}$-AA$^{19}$-AA$^{20}$; wherein AA$^{18}$ is selected from the group consisting of L, V, Q, A and R; wherein AA$^{19}$ is selected from the group consisting of F, W, H, Y, I and K, in particular is selected from the group consisting of Y, I and K; wherein AA$^{20}$ is selected from the group consisting of L, F, Y, K, I, V and M, in particular is selected from the group consisting of Y, M, V and I. In one particular example, PEP11 is selected from the group consisting of VYY, LYY, QIM, AKV and RKI.

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, PEP1 is selected from the group consisting of EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358); PEP11 is selected from the group consisting of VYY, LYY, QIM, AKV and RKI; and the pair PEP1:PEP11 is selected from the group consisting of EPLP (SEQ ID NO: 6354):VYY, EPLT (SEQ ID NO: 6355):LYY, SNIT (SEQ ID NO: 6362):QIM, RSVK (SEQ ID NO: 6359):KEVQV and RPVQ (SEQ ID NO: 6358):KKATV.

The definitions of "PEP" pairs and triplets e.g. PEP3:PEP1, PEP5:PEP12, or PEP7:PEP5:PEP1, also most particularly useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, are as already defined herein to the extent that PEP1, PEP3, PEP5, PEP7, PEP9, PEP11 and PEP12 are particularly useful for these applications as defined in the present skin regeneration section.

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, said GFR-binding compound is a synthetic molecule as defined herein in the definition section.

In certain embodiments useful for inducing differentiation of mensenchymal or progenitor stem cells from the fibroblast lineage, inducing skin tissue regeneration and tubular formation, preventing, attenuating, masking or removing wrinkles, firming the skin, preventing, decreasing or suppressing skin pigmentation, and protecting patients from skin tissue degeneration-related diseases, disorders, conditions or pathologies, said GFR-binding compound is a synthetic peptide, or a variant or analog thereof, or a peptidomimetic.

Hair

Certain embodiments of the invention are particularly useful for inducing differentiation of mensenchymal or progenitor stem cells from the hair follicle cell lineage, hair follicle tissue regeneration and formation (hair growth), and for protecting from hair follicle-related diseases, disorders, conditions or pathologies.

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP1 is SSLS (SEQ ID NO: 6365).

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP3 is selected from the group consisting of VPT, VPE, APT, TPT, VPA, APV, VPQ, VSQ and SRV.

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP5 is a peptide of general formula PEP3-AA$^{11}$-AA$^{12}$; wherein PEP3 is selected from the group consisting of VPT, VPE, APT, TPT, VPA, APV, VPQ, VSQ and SRV; wherein AA$^{11}$ is selected from the group consisting of E, K, Q, R, A, D, G and H, in particular is selected from the group consisting of E, K, Q, R, A, D and H; wherein AA$^{12}$ is selected from the group consisting of L, M, T, E, Q and H, in particular is selected from the group consisting of L, M, T, E and H. In one particular example, PEP5 is selected from the group consisting of VPTEL (SEQ ID NO: 6421), VPEKM (SEQ ID NO: 6406), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427), APVKT (SEQ ID NO: 6379), VPQAL (SEQ ID NO: 6410), VSQDL (SEQ ID NO: 6429), VPQDL (SEQ ID NO: 6411), VPTEE (SEQ ID NO: 6420) and SRVHH (SEQ ID NO: 6382).

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP7 is an amino acid or a peptide with between two and seven amino acids of general formula AA$^1$-AA$^2$-AA$^3$-AA$^4$-

AA$^5$-AA$^6$-AA$^7$ (SEQ ID NO: 6606); wherein AA$^1$, AA$^2$, AA$^3$, AA$^4$, and AA$^5$ are independently absent or AA$^I$ as defined herein; wherein AA$^6$ is absent or selected from the group consisting of S, T, C, E, Q, P and R, preferably is selected from the group consisting of C, S, T, E and Q; wherein AA$^7$ is absent or is selected from the group consisting of S, T, C, E, Q, P and R, preferably is selected from the group consisting of S, C and P; and wherein at least one of AA$^1$, AA$^2$, AA$^3$, AA$^4$, AA$^5$, AA$^6$ or AA$^7$ is not absent. In one particular example, PEP7 is selected from the group consisting of KIPKAXX (SEQ ID NO: 6445), GIPEPXX (SEQ ID NO: 6440), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPASXX (SEQ ID NO: 6436), STPPTXX (SEQ ID NO: 6452), HVPKPXX (SEQ ID NO: 6442), RVPSTXX (SEQ ID NO: 6449), ASAAPXX (SEQ ID NO: 6437), ASASPXX (SEQ ID NO: 6438), NDEGLEX (SEQ ID NO: 6447) and SSVKXQP (SEQ ID NO: 6451).

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP9 is a peptide of general formula AA$^1$-AA$^2$-AA$^3$-AA$^4$-AA$^5$-AA$^6$-AA$^7$-PEP5; wherein PEP5 is a peptide of formula PEP3-AA$^{11}$-AA$^{12}$; wherein PEP3 is selected from the group consisting of VPT, VPE, APT, TPT, VPA, APV, VPQ, VSQ and SRV; wherein AA$^{11}$ is selected from the group consisting of E, K, Q, R, A, D, G and H, in particular is selected from the group consisting of E, K, Q, R, A, D and H; wherein AA$^{12}$ is selected from the group consisting of L, M, T, E, Q and H, in particular is selected from the group consisting of L, M, T, E and H; wherein AA$^1$, AA$^2$, AA$^3$, AA$^4$, and AA$^5$ are independently absent or AA$^I$ as defined herein; wherein AA$^6$ is absent or selected from the group consisting of S, T, C, E, Q, P and R, preferably is selected from the group consisting of C, S, T, E and Q; wherein AA$^7$ is selected from the group consisting of S, T, C, E, Q, P and R, preferably is selected from the group consisting of S, C and P. In one particular example, PEP9 is selected from the group consisting of KIPKAXXVPTEL (SEQ ID NO: 6535), GIPEPXXVPEKM (SEQ ID NO: 6491), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXXTPTKM (SEQ ID NO: 6497), AAPASXXVPARL (SEQ ID NO: 6458), STPPTXXVPTRL (SEQ ID NO: 6573), HVPKPXXAPTKL (SEQ ID NO: 6503), RVPSTXXAPVKT (SEQ ID NO: 6550), ASAAPXXVPQAL (SEQ ID NO: 6468), ASASPXXVSQDL (SEQ ID NO: 6478), ASASPXXVPQDL (SEQ ID NO: 6476), NDEGLEXVPTEE (SEQ ID NO: 6545) and SSVKXQPSRVHH (SEQ ID NO: 6565).

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP12 is a peptide of general formula PEP1-AA$^{17}$-PEP11; wherein AA$^{17}$ is selected from the group consisting of G, A, V, L, I, P, F, M, W, T and S (in particular is selected from the group consisting of M, I, L, V and T); wherein PEP1 is SSLS (SEQ ID NO: 6365).

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP11 is a peptide with 3 amino acids of general formula AA$^{18}$-AA$^{19}$-AA$^{20}$; wherein AA$^{18}$ is selected from the group consisting of L, V, Q, A and R, in particular is L; wherein AA$^{19}$ is selected from the group consisting of F, W, H, Y, I and K, in particular is F; wherein AA$^{20}$ is selected from the group consisting of L, F, Y, K, I, V and M, in particular is F. In one particular example, PEP11 is LFF.

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, PEP1 is SSLS (SEQ ID NO: 6365) and PEP11 is LFF.

The definitions of "PEP" pairs and triplets e.g. PEP3:PEP1, PEP5:PEP12, or PEP7:PEP5:PEP1, also most particularly useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, are as already defined herein to the extent that PEP1, PEP3, PEP5, PEP7, PEP9, PEP11 and PEP12 are particularly useful for these applications as defined in the present fertility and reproduction section.

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, said GFR-binding compound is a synthetic molecule as defined herein in the definition section.

In certain embodiments useful for inducing differentiation of mensenchymal or progenitor stem cells from the hair follicle cell lineage, hair follicle tissue regeneration and formation (hair growth), and for protecting from hair follicle-related diseases, disorders, conditions or pathologies, said GFR-binding compound is a synthetic peptide, or a variant or analog thereof, or a peptidomimetic.

Fertility and Reproduction

Certain embodiments of the invention are particularly useful for inducing differentiation of mensenchymal or progenitor stem cells from the reproduction system lineage, enhancing female fertility, treating, preventing, decreasing or suppressing female infertility or any diseases, conditions, disorders or pathologies related thereof.

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP1 is NAIS (SEQ ID NO: 6357).

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP3 is selected from the group consisting of VPT, APT, TPT, VPA and APV.

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP5 is a peptide of general formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is selected from the group consisting of E, K, Q and R; wherein $AA^{12}$ is selected from the group consisting of L, M, T, E, Q and H, in particular is selected from the group consisting of L, M and T. In one particular example, PEP5 is selected from the group consisting of VPTEL (SEQ ID NO: 6421), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427) and APVKT (SEQ ID NO: 6379).

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of C, S and T; wherein $AA^7$ is absent or is selected from the group consisting of S, T, C, E, Q, P and R, preferably is selected from the group consisting of S and C; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPASXX (SEQ ID NO: 6436), STPPTXX (SEQ ID NO: 6452), HVPKPXX (SEQ ID NO: 6442) and RVPSTXX (SEQ ID NO: 6449).

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, APT, TPT, VPA and APV; wherein $AA^{11}$ is selected from the group consisting of E, K, Q, R, A, D, G and H, in particular is selected from the group consisting of E, K, Q and R; wherein $AA^{12}$ is selected from the group consisting of L, M, T, E, Q and H, in particular is selected from the group consisting of L, M and T; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of C, S and T; wherein $AA^7$ is selected from the group consisting of S, T, C, E, Q, P and R, preferably is selected from the group consisting of S and C. In one particular example, PEP9 is selected from the group consisting of KIPKAXXVPTEL (SEQ ID NO: 6535), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXXTPTKM (SEQ ID NO: 6497), AAPASXXVPARL (SEQ ID NO: 6458), STPPTXXVPTRL (SEQ ID NO: 6573), HVPKPXXAPTKL (SEQ ID NO: 6503) and RVPSTXXAPVKT (SEQ ID NO: 6550).

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP12 is a peptide of general formula PEP1-$AA^{17}$-PEP11; wherein $AA^{17}$ is selected from the group consisting of G, A, V, L, I, P, F, M, W, T and S (in particular is selected from the group consisting of M, I, L, V and T); wherein PEP1 is NAIS (SEQ ID NO: 6357).

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H, Y, I and K, in particular is Y; wherein $AA^{20}$ is selected from the group consisting of L, F, Y, K, I, V and M, in particular is F. In one particular example, PEP11 is LYF.

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, PEP1 is NAIS (SEQ ID NO: 6357) and PEP11 is LYF.

The definitions of "PEP" pairs and triplets e.g. PEP3:PEP1, PEP5:PEP12, or PEP7:PEP5:PEP1, also most particularly useful for inducing differentiation of mensenchymal or progenitor stem cells from the reproduction system lineage, enhancing female fertility, treating, preventing, decreasing or suppressing female infertility or any diseases, conditions, disorders or pathologies related thereof, are as already defined herein to the extent that PEP1, PEP3, PEP5, PEP7, PEP9, PEP11 and PEP12 are particularly useful for these applications as defined in the present fertility and reproduction section.

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, said GFR-binding compound is a synthetic molecule as defined herein in the definition section.

In certain embodiments useful for inducing differentiation of mensenchymal or progenitor stem cells from the reproduction system lineage, enhancing female fertility, treating, preventing, decreasing or suppressing female infertility or any diseases, conditions, disorders or pathologies related thereof, said GFR-binding compound is a synthetic peptide, or a variant or analog thereof, or a peptidomimetic.

Lung Certain embodiments of the invention are particularly useful for inducing differentiation of mensenchymal or progenitor stem cells from the lung cell lineage, regenerating lung tissues, and protecting patients from lung tissue degeneration-related diseases, conditions, disorders or pathologies.

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP1 is selected from the group consisting of NAIS (SEQ ID NO: 6357), SATS (SEQ ID NO: 6361), SPIS (SEQ ID NO: 6364), EPIS (SEQ ID NO: 6353) and SPIN (SEQ ID NO: 6363).

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP3 is selected from the group consisting of VPT, VPE, APT, TPT, VPA, APV, VPQ and VSQ.

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP5 is a peptide of general formula PEP3-$AA^{11}$-$AA^{12}$; wherein PEP3 is selected from the group consisting of VPT, VPE, APT, TPT, VPA, APV, VPQ and VSQ; wherein $AA^{11}$ is selected from the group consisting of E, K, Q, R, A, D, G and H, in particular is selected from the group consisting of E, K, Q, R, A and D; wherein $AA^{12}$ is selected from the group consisting of L, M, T, E, Q and H, in particular selected from the group consisting of L, M and T. In one particular example, PEP5 is selected from the group consisting of VPTEL (SEQ ID NO: 6421), VPEKM (SEQ ID NO: 6406), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427), APVKT (SEQ ID NO: 6379), VPQAL (SEQ ID NO: 6410), VSQDL (SEQ ID NO: 6429) and VPQDL (SEQ ID NO: 6411).

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of C, S and T; wherein $AA^7$ is absent or is selected from the group consisting of S, T, C, E, Q, P and R, preferably is C or S; and wherein at least one of $AA^1$, $AA^2$, $AA^3$, $AA^4$, $AA^5$, $AA^6$ or $AA^7$ is not absent. In one particular example, PEP7 is selected from the group consisting of KIPKAXX (SEQ ID NO: 6445), GIPEPXX (SEQ ID NO: 6440), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPASXX (SEQ ID NO: 6436), STPPTXX (SEQ ID NO: 6452), HVPKPXX (SEQ ID NO: 6442), RVPSTXX (SEQ ID NO: 6449), ASAAPXX (SEQ ID NO: 6437) and ASASPXX (SEQ ID NO: 6438).

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPT, VPE, APT, TPT, VPA, APV, VPQ and VSQ; wherein $AA^{11}$ is selected from the group consisting of E, K, Q, R, A, D, G and H, in particular E, K, Q, R, A and D; wherein $AA^{12}$ is selected from the group consisting of L, M, T, E, Q and H, in particular selected from the group consisting of L, M and T; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of C, S and T; wherein $AA^7$ is selected from the group consisting of S, T, C, E, Q, P and R, preferably is C or S. In one particular example, PEP9 is selected from the group consisting of KIPKAXXVPTEL (SEQ ID NO: 6535), GIPEPXXVPEKM (SEQ ID NO: 6491), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXXTPTKM (SEQ ID NO: 6497), AAPASXXVPARL (SEQ ID NO: 6458), STPPTXXVPTRL (SEQ ID NO: 6573), HVPKPXXAPTKL (SEQ ID NO: 6503), RVPSTXXAPVKT (SEQ ID NO: 6550), ASAAPXXVPQAL (SEQ ID NO: 6468), ASASPXXVSQDL (SEQ ID NO: 6478) and ASASPXXVPQDL (SEQ ID NO: 6476).

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP12 is a peptide of general formula PEP1-AA17-PEP11; wherein $AA^{17}$ is selected from the group consisting of G, A, V, L, I, P, F, M, W, T and S (in particular is selected from the group consisting of M, I, L, V and T); wherein PEP1 is selected from the group consisting of NAIS (SEQ ID NO: 6357), SATS (SEQ ID NO: 6361), SPIS (SEQ ID NO: 6364), EPIS (SEQ ID NO: 6353) and SPIN (SEQ ID NO: 6363).

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP11 is a peptide with 3 amino acids of general formula $AA^{18}$-$AA^{19}$-$AA^{20}$; wherein $AA^{18}$ is selected from the group consisting of L, V, Q, A and R, in particular is L; wherein $AA^{19}$ is selected from the group consisting of F, W, H and Y (in particular is a polar aromatic amino acid such as Y); wherein $AA^{20}$ is selected from the group consisting of L, F, Y, K, I, V and M, in particular is selected from the group consisting of L, F, Y, and K. In one particular example, PEP11 is selected from the group consisting of LYF, LYY, LYK and LYL.

In certain embodiments useful for inducing differentiation of mensenchymal or progenitor stem cells from the lung cell lineage, regenerating lung tissues, and protecting patients from lung tissue degeneration-related diseases, conditions, disorders or pathologies, PEP1 is selected from the group consisting of NAIS (SEQ ID NO: 6357), SATS (SEQ ID NO: 6361), SPIS (SEQ ID NO: 6364), EPIS (SEQ ID NO: 6353) and SPIN (SEQ ID NO: 6363); PEP11 is selected from the group consisting of LYF, LYY, LYK and LYL; and the pair PEP1:PEP11 is selected from the group consisting of NAIS (SEQ ID NO: 6357):LYF, SATS (SEQ ID NO: 6361):LYY, SPIS (SEQ ID NO: 6364):LYK, EPIS (SEQ ID NO: 6353):LYL and SPIN (SEQ ID NO: 6363): LYF.

The definitions of "PEP" pairs and triplets e.g. PEP3: PEP1, PEP5:PEP12, or PEP7:PEP5:PEP1, also most particularly useful for inducing differentiation of mensenchymal or progenitor stem cells from the lung cell lineage, regenerating lung tissues, and protecting patients from lung tissue degeneration-related diseases, conditions, disorders or pathologies, are as already defined herein to the extent that PEP1, PEP3, PEP5, PEP7, PEP9, PEP11 and PEP12 are particularly useful for these applications as defined in the present lung section.

In certain embodiments useful for inducing differentiation of mensenchymal or progenitor stem cells from the lung cell lineage, regenerating lung tissues, and protecting patients from lung tissue degeneration-related diseases, conditions, disorders or pathologies, said GFR-binding compound is a synthetic molecule as defined herein in the definition section.

In certain embodiments useful for inducing differentiation of mensenchymal or progenitor stem cells from the lung cell lineage, regenerating lung tissues, and protecting patients from lung tissue degeneration-related diseases, conditions, disorders or pathologies, said GFR-binding compound is a synthetic peptide, or a variant or analog thereof, or a peptidomimetic.

Muscle

Certain embodiments of the invention are particularly useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies.

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP1 is RSVK (SEQ ID NO: 6359) or RPVQ (SEQ ID NO: 6358).

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP3 is selected from the group consisting of VPQ, VSQ and VPT.

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP5 is a peptide of general formula PEP3-$AA^{11}$-$AA^{12}$; wherein PEP3 is selected from the group consisting of VPQ, VSQ and VPT; wherein $AA^{11}$ is selected from the group consisting of E, K, Q, R, A, D, G and H, in particular A, D, E and G; wherein $AA^{12}$ is selected from the group consisting of L, M, T, E, Q and H, in particular L, E and Q. In one particular example, PEP5 is selected from the group consisting of VPQAL (SEQ ID NO: 6410), VSQDL (SEQ ID NO: 6429), VPQDL (SEQ ID NO: 6411), VPTEE (SEQ ID NO: 6420) and VPTGQ (SEQ ID NO: 6422).

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably C, S, or E; wherein $AA^7$ is absent or is selected from the group consisting of S, T, C, E, Q, P and R, preferably is S or C; and wherein at least one of $AA^1$, $AA^2$, $AA^3$, $AA^4$, $AA^5$, $AA^6$ or $AA^7$ is not absent. In one particular example, PEP7 is selected from the group consisting of ASAAPXX (SEQ ID NO: 6437), ASASPXX (SEQ ID NO: 6438) and NDEGLEX (SEQ ID NO: 6447).

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of VPQ, VSQ and VPT; wherein $AA^{11}$ is selected from the group consisting of E, K, Q, R, A, D, G and H, in particular A, D, E and G; wherein $AA^{12}$ is selected from the group consisting of L, M, T, E, Q and H, in particular L, E and Q; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably C, S, or E; wherein $AA^7$ is selected from the group consisting of S, T, C, E, Q, P and R, preferably is S or C. In one particular example, PEP9 is selected from the group consisting of ASAAPXXVPQAL (SEQ ID NO: 6468), ASASPXXVSQDL (SEQ ID NO: 6478), ASASPXXVPQDL (SEQ ID NO: 6476), NDEGLEXVPTEE (SEQ ID NO: 6545) and NDEGLEXVPTGQ (SEQ ID NO: 6546).

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP12 is a peptide of general formula PEP1-$AA^{17}$-PEP11; wherein $AA^{17}$ is selected from the group consisting of G, A, V, L, I, P, F, M, W, T and S (in particular is I or M); wherein PEP1 is RSVK (SEQ ID NO: 6359) or RPVQ (SEQ ID NO: 6358).

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP11 is a peptide with 3 amino acids of general formula $AA^{18}$-$AA^{19}$-$AA^{20}$; wherein $AA^{18}$ is selected from the group consisting of L, V, Q, A and R, in particular is A or R; wherein $AA^{19}$ is selected from the group consisting of $AA^{VII}$ amino acids (in particular is K); wherein $AA^{20}$ is selected from the group consisting of L, F, Y, K, I, V and M, in particular is V or I. In one particular example, PEP11 is AKV or RKI.

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, PEP1 is RSVK (SEQ ID NO: 6359) or RPVQ (SEQ ID NO: 6358); PEP11 is AKV or RKI; and the pair PEP1:PEP11 is RSVK (SEQ ID NO: 6359):AKV or RPVQ (SEQ ID NO: 6358):RKI.

The definitions of "PEP" pairs and triplets e.g. PEP3: PEP1, PEP5:PEP12, or PEP7:PEP5:PEP1, also most particularly embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, are as already defined herein to the extent that PEP1, PEP3, PEP5, PEP7, PEP9, PEP11 and PEP12 are particularly useful for these applications as defined in the present muscle section.

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, said GFR-binding compound is a synthetic molecule as defined herein in the definition section.

In certain embodiments useful for inducing differentiation of mensenchymal or progenitor stem cells from the muscle cell lineage, regenerating muscle tissues, enhancing of myogenesis, reinforcing muscle tissues, repairing damaged muscles, and protecting a subject from one or more muscle tissue degeneration-related diseases, disorders, conditions or pathologies, said GFR-binding compound is a synthetic peptide, or a variant or analog thereof, or a peptidomimetic.

Blood

Certain embodiments of the invention are particularly useful for inducing differentiation of mensenchymal or progenitor stem cells from the blood cell lineage, regenerating blood tissues, and protecting patients from blood cell degeneration-related disease, conditions, disorders or pathologies.

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP1 is SNIT (SEQ ID NO: 6362).

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP3 is selected from the group consisting of TPT, VPA, VPT, APT, APV, VPQ, VSQ, SRV and TQV.

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP5 is a peptide of general formula PEP3-$AA^{11}$-$AA^{12}$; wherein PEP3 is selected from the group consisting of TPT, VPA, VPT, APT, APV, VPQ, VSQ, SRV and TQV; wherein $AA^{11}$ is selected from the group consisting of E, K, Q, R, A, D, G and H, in particular is selected from the group consisting of K, R, A, D, H and Q; wherein $AA^{12}$ is selected from the group consisting of L, M, T, E, Q and H, in particular is selected from the group consisting of M, L, T and H. In one particular example, PEP5 is selected from the group consisting of TPTKM (SEQ ID NO: 6388), VPARL (SEQ ID NO: 6401), VPTRL (SEQ ID NO: 6427), APTKL (SEQ ID NO: 6369), APVKT (SEQ ID NO: 6379), VPQAL (SEQ ID NO: 6410), VSQDL (SEQ ID NO: 6429), VPQDL (SEQ ID NO: 6411), SRVHH (SEQ ID NO: 6382) and TQVQL (SEQ ID NO: 6393).

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP7 is an amino acid or a peptide with between two and seven amino acids of general formula $AA^1$-$AA^2$-$AA^3$-$AA^4$-$AA^5$-$AA^6$-$AA^7$ (SEQ ID NO: 6606); wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of S, C, Q and R; wherein $AA^7$ is absent or is selected from the group consisting of S, T, C, E, Q, P and R, preferably is selected from the group consisting of C, S and P; and wherein at least one of $AA^1$, $AA^2$, $AA^3$, $AA^4$, $AA^5$, $AA^6$ or $AA^7$ is not absent. In one particular example, PEP7 is selected from the group consisting of GSAGPXX (SEQ ID NO: 6441), AAPASXX (SEQ ID NO: 6436), STPPTXX (SEQ ID NO: 6452), HVPKPXX (SEQ ID NO: 6442), RVPSTXX (SEQ ID NO: 6449), ASAAPXX (SEQ ID NO: 6437), ASASPXX (SEQ ID NO: 6438), SSVKXQP (SEQ ID NO: 6451) and RNVQXRP (SEQ ID NO: 6448).

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP9 is a peptide of general formula $AA^1$-$AA^2$-$AA^3$-$AA^4$-$AA^5$-$AA^6$-$AA^7$-PEP5; wherein PEP5 is a peptide of formula PEP3-$AA^{11}$-$AA^{12}$; wherein PEP3 is selected from the group consisting of TPT, VPA, VPT, APT, APV, VPQ, VSQ, SRV and TQV; wherein $AA^{11}$ is selected from the group consisting of E, K, Q, R, A, D, G and H, in particular is selected from the group consisting of K, R, A, D, H and Q; wherein $AA^{12}$ is selected from the group consisting of L, M, T, E, Q and H, in particular is selected from the group consisting of M, L, T and H; wherein $AA^1$, $AA^2$, $AA^3$, $AA^4$, and $AA^5$ are independently absent or $AA^I$ as defined herein; wherein $AA^6$ is absent or selected from the group consisting of S, T, C, E, Q, P and R, preferably is selected from the group consisting of S, C, Q and R; wherein $AA^7$ is selected from the group consisting of S, T, C, E, Q, P and R, preferably is selected from the group consisting of C, S and P. In one particular example, PEP9 is selected from the group consisting of GSAGPXXTPTKM (SEQ ID NO: 6497), AAPASXXVPARL (SEQ ID NO: 6458), STPPTXXVPTRL (SEQ ID NO: 6573), HVPKPXXAPTKL (SEQ ID NO: 6503), RVPSTXXAPVKT (SEQ ID NO: 6550), ASAAPXXVPQAL (SEQ ID NO: 6468), ASASPXXVSQDL (SEQ ID NO: 6478), ASASPXXVPQDL (SEQ ID NO: 6476), SSVKXQPSRVHH (SEQ ID NO: 6565) and RNVQXRPTQVQL (SEQ ID NO: 6548).

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP12 is a peptide of general formula PEP1-AA$^{17}$-PEP11; wherein AA$^{17}$ is selected from the group consisting of G, A, V, L, I, P, F, M, W, T and S (in particular is selected from the group consisting of M, I, V and T); wherein PEP1 is SNIT (SEQ ID NO: 6362).

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP11 is a peptide with 3 amino acids of general formula AA$^{18}$-AA$^{19}$-AA$^{20}$; wherein AA$^{18}$ is selected from the group consisting of L, V, Q, A and R, in particular is Q; wherein AA$^{19}$ is selected from the group consisting of F, W, H, I and Y (in particular is I); wherein AA20 is selected from the group consisting of L, F, Y, K, I, V and M, in particular is M. In one particular example, PEP11 is QIM.

In certain embodiments useful for inducing differentiation of mensenchymal or progenitor stem cells from the blood cell lineage, regenerating blood tissues, and protecting patients from blood cell degeneration-related disease, conditions, disorders or pathologies, PEP1 is SNIT (SEQ ID NO: 6362) and PEP11 is QIM.

The definitions of "PEP" pairs and triplets e.g. PEP3:PEP1, PEP5:PEP12, or PEP7:PEP5:PEP1, also most particularly embodiments useful for inducing differentiation of mensenchymal or progenitor stem cells from the blood cell lineage, regenerating blood tissues, and protecting patients from blood cell degeneration-related disease, conditions, disorders or pathologies, are as already defined herein to the extent that PEP1, PEP3, PEP5, PEP7, PEP9, PEP11 and PEP12 are particularly useful for these applications as defined in the present blood section.

In certain embodiments useful for inducing differentiation of mensenchymal or progenitor stem cells from the blood cell lineage, regenerating blood tissues, and protecting patients from blood cell degeneration-related disease, conditions, disorders or pathologies, said GFR-binding compound is a synthetic molecule as defined herein in the definition section.

In certain embodiments useful for inducing differentiation of mensenchymal or progenitor stem cells from the blood cell lineage, regenerating blood tissues, and protecting patients from blood cell degeneration-related disease, conditions, disorders or pathologies, said GFR-binding compound is a synthetic peptide, or a variant or analog thereof, or a peptidomimetic.

Adipose tissues Certain embodiments of the invention are particularly useful for inducing differentiation of mensenchymal or progenitor stem cells from the adipocyte lineage, regenerating adipose tissues and protecting patients from adipose tissue degeneration-related diseases, conditions, disorders or pathologies.

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP1 is SAIS (SEQ ID NO: 6360) or NAIS (SEQ ID NO: 6357).

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP3 is selected from the group consisting of VPT, VPE, APT, TPT, VPA, APV, VPQ and VSQ.

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP5 is a peptide of general formula PEP3-AA$^{11}$-AA$^{12}$; wherein PEP3 is selected from the group consisting of VPT, VPE, APT, TPT, VPA, APV, VPQ and VSQ; wherein AA$^{11}$ is selected from the group consisting of E, K, Q, R, A, D, G and H, in particular is selected from the group consisting of E, K, Q, R, A and D; wherein AA$^{12}$ is selected from the group consisting of L, M, T, E, Q and H, in particular selected from the group consisting of L, M and T. In one particular example, PEP5 is selected from the group consisting of VPTEL (SEQ ID NO: 6421), VPEKM (SEQ ID NO: 6406), APTKL (SEQ ID NO: 6369), APTQL (SEQ ID NO: 6372), VPTKL (SEQ ID NO: 6423), TPTKM (SEQ ID NO: 6388), VPARL (SEQ ID NO: 6401), VPTRL (SEQ ID NO: 6427), APVKT (SEQ ID NO: 6379), VPQAL (SEQ ID NO: 6410), VSQDL (SEQ ID NO: 6429) and VPQDL (SEQ ID NO: 6411).

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP7 is an amino acid or a peptide with between two and seven amino acids of general formula AA$^{1}$-AA$^{2}$-AA$^{3}$-AA$^{4}$-AA$^{5}$-AA$^{6}$-AA$^{7}$ (SEQ ID NO: 6606); wherein AA$^{1}$, AA$^{2}$, AA$^{3}$, AA$^{4}$, and AA$^{5}$ are independently absent or AA$^{I}$ as defined herein; wherein AA$^{6}$ is absent or selected from the group consisting of S, T, C, E, Q, P and R, preferably is selected from the group consisting of C, S and T; wherein AA$^{7}$ is absent or is selected from the group consisting of S, T, C, E, Q, P and R, preferably is C or S; and wherein at least one of AA$^{1}$, AA$^{2}$, AA$^{3}$, AA$^{4}$, AA$^{5}$, AA$^{6}$ or AA$^{7}$ is not absent. In one particular example, PEP7 is selected from the group consisting of KIPKAXX (SEQ ID NO: 6445), GIPEPXX (SEQ ID NO: 6440), SIPKAXX (SEQ ID NO: 6450), HVTKPTX (SEQ ID NO: 6443), YVPKPXX (SEQ ID NO: 6454), TVPKPXX (SEQ ID NO: 6453), AVPKAXX (SEQ ID NO: 6439), KVGKAXX (SEQ ID NO: 6446), KASKAXX (SEQ ID NO: 6444), GSAGPXX (SEQ ID NO: 6441), AAPASXX (SEQ ID NO: 6436), STPPTXX (SEQ ID NO: 6452), HVPKPXX (SEQ ID NO: 6442), RVPSTXX (SEQ ID NO: 6449), ASAAPXX (SEQ ID NO: 6437) and ASASPXX (SEQ ID NO: 6438).

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP9 is a peptide of general formula AA$^{1}$-AA$^{2}$-AA$^{3}$-AA$^{4}$-AA$^{5}$-AA$^{6}$-AA$^{7}$-PEP5; wherein PEP5 is a peptide of formula PEP3-AA$^{11}$-AA$^{12}$; wherein PEP3 is selected from the group consisting of VPT, VPE, APT, TPT, VPA, APV, VPQ and VSQ; wherein AA$^{11}$ is selected from the group consisting of E, K, Q, R, A, D, G and H, in particular E, K, Q, R, A and D; wherein AA$^{12}$ is selected from the group consisting of L, M, T, E, Q and H, in particular selected from the group consisting of L, M and T; wherein AA$^{1}$, AA$^{2}$, AA$^{3}$, AA$^{4}$, and AA$^{5}$ are independently absent or AA$^{I}$ as defined herein; wherein AA$^{6}$ is absent or selected from the group consisting of S, T, C, E, Q, P and R, preferably is selected from the group consisting of C, S and T; wherein AA$^7$ is selected from the group consisting of S, T, C, E, Q, P and R, preferably is C or S. In one particular example, PEP9 is selected from the group consisting of KIPKAXXVPTEL (SEQ ID NO: 6535), GIPEPXXVPEKM (SEQ ID NO: 6491), SIPKAXXVPTEL (SEQ ID NO: 6563), HVTKPTXAPTKL (SEQ ID NO: 6511), YVPKPXXAPTKL (SEQ ID NO: 6583), TVPKPXXAPTQL (SEQ ID NO: 6575), AVPKAXXAPTKL (SEQ ID NO: 6479), KVGKAXXVPTKL (SEQ ID NO: 6543), KASKAXXVPTKL (SEQ ID NO: 6527), GSAGPXXTPTKM (SEQ ID NO: 6497), AAPASXXVPARL (SEQ ID NO: 6458), STPPTXXVPTRL (SEQ ID NO: 6573), HVPKPXXAPTKL (SEQ ID NO: 6503), RVPSTXXAPVKT (SEQ ID NO: 6550), ASAAPXXVPQAL (SEQ ID NO: 6468), ASASPXXVSQDL (SEQ ID NO: 6478) and ASASPXXVPQDL (SEQ ID NO: 6476).

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP12 is a peptide of general formula PEP1-AA$^{17}$-PEP11; wherein AA$^{17}$ is selected from the group consisting of G, A, V, L, I, P, F, M, W, T and S (in particular is selected from the group consisting of M, V and T); wherein PEP1 is SAIS (SEQ ID NO: 6360) or NAIS (SEQ ID NO: 6357).

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP11 is a peptide with 3 amino acids of general formula AA$^{18}$-AA$^{19}$-AA$^{20}$; wherein AA$^{18}$ is selected from the group consisting of L, V, Q, A and R, in particular is L; wherein AA$^{19}$ is selected from the group consisting of F, W, H and Y (in particular is a polar aromatic amino acid such as Y); wherein AA$^{20}$ is selected from the group consisting of L, F, Y, K, I, V and M, in particular is L or F. In one particular example, PEP11 is LYL or LYF.

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, PEP1 is SAIS (SEQ ID NO: 6360) or NAIS (SEQ ID NO: 6357); PEP11 is LYL or LYF; and the pair PEP1:PEP11 is SAIS (SEQ ID NO: 6360):LYL or NAIS (SEQ ID NO: 6357):LYF.

The definitions of "PEP" pairs and triplets e.g. PEP3:PEP1, PEP5:PEP12, or PEP7:PEP5:PEP1, also most particularly embodiments useful for inducing differentiation of mensenchymal or progenitor stem cells from the adipocyte lineage, regenerating adipose tissues and protecting patients from adipose tissue degeneration-related diseases, conditions, disorders or pathologies, are as already defined herein to the extent that PEP1, PEP3, PEP5, PEP7, PEP9, PEP11 and PEP12 are particularly useful for these applications as defined in the present adipose tissue section.

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, said GFR-binding compound is a synthetic molecule as defined herein in the definition section.

In certain embodiments useful for inducing differentiation of mensenchymal or progenitor stem cells from the adipocyte lineage, regenerating adipose tissues and protecting patients from adipose tissue degeneration-related diseases, conditions, disorders or pathologies, said GFR-binding compound is a synthetic peptide, or a variant or analog thereof, or a peptidomimetic.

Tissue Closure

In certain embodiments useful for promoting tissue closure, the choice of PEP1, PEP3, PEP5, PEP7, PEP9, PEP12, PEP11 and AA$^{17}$ will depend on the type of specific tissue closure to be performed and may include any of the suitable amino acids, peptides, analog or variant thereof, or peptidomimetic, already disclosed herein with respect to the bone, cartilage, vascular, wound healing, neuronal, eye-retinal, kidneys, liver, L/T and skin applications. For instance, in certain embodiments, during bone repair surgery, different layers of tissue such as skin, muscle and blood vessel are incised in order to reach the damaged bone part. Thus, suitable PEP1, PEP3, PEP5, PEP7, PEP9, PEP12, PEP11 and AA$^{17}$ for implementing embodiments of the invention in this specific situation may include such amino acids, peptides, analog or variant thereof, or peptidomimetic, already described herein with respect to skin, muscle, vascular and bone tissue regeneration/formation and cell migration. Likewise, for example, in certain embodiments, during heart surgery, different layers of tissue such as skin, muscle and blood vessel, are incised in order to reach the patient's heart. Thus, suitable PEP1, PEP3, PEP5, PEP7, PEP9, PEP12, PEP11 and AA$^{17}$ for implementing embodiments of the invention in this specific situation include such amino acids, peptides, analog or variant thereof, or peptidomimetic, already described herein with respect to the skin, muscle and blood vessel tissue regeneration/formation and cell migration.

III. Bioactive Carriers

The present invention may achieve its intended therapeutic and/or cosmetic action(s) e.g. through efficient tissue induction, by functional combination (or association) with a bioactive carrier.

In one example, said GFR-binding compound and said bioactive carrier are thus operably associated, combined, linked or connected as defined herein and thus may form a pharmaceutical, dermatological, prophylactic, diagnostic, imaging or cosmetic association or combination for uses and methods as defined herein.

As may be used herein, the term "bioactive carrier", "biocompatible carrier", "bioactive material", "biocompatible material", "bioactive substance", "bio-substance", "biocompatible substance", are used interchangeably.

A suitable bioactive carrier is compatible with living cells, tissues, organs or systems posing little to no risk of injury, toxicity or rejection by the immune system. Bioactive carriers suitable for implementing embodiments of the present invention include, but are not limited to, (a) a biopolymer such as (a1) collagen, (a2) fibrin; (b) a synthetic polymer such as (b1) ultra-high molecular weight polyethylene (UHMWPE), (b2) polyurethane (PE), (b3) polyurethane (PU), (b4) polytetrafluoroethylene (PTFE), (b5) polyacetal (PA), (b6) polymethylmethacrylate (PMMA), (b7) polyethylene terepthalate (PET), (b8) silicone rubber (SR), (b9) polyetheretherketone (PEEK), (b10) poly(lactic acid) (PLA), (b11) polysulfone (PS), (b12) PLLA, (b13) PLGA or (b14) PLDA; (c) metals and metal oxides such as (c1) gold and gold alloys, (c2) silver and silver alloys, (c3) platinum and platinum alloys, (c4) tantalum, (c5) Ti6Al4V, (c6) 316L stainless steel, (c7) Co—Cr Alloys, (c8) titanium alloys such as such as □-type, □-type, □+□-type Ti alloy, Ti—Nb alloys such as Ti29Nb13Ta4.6Zr or Ti35Nb4Sn); (d) metallic glasses; (e) amorphous alloys such as Zr-based alloys; (f) porous metals such as the ones reported in Ryan et al., 2006, Biomaterials, 27, 2651; Lopez-Heredia et al. 2008, Biomaterials, 29, 2608; Ryan et al., 2008, Biomaterials, 29, 3625; Li et al., 2007, Biomaterials, 28, 2810; or Hollander et al., 2006, Biomaterials, 27, 955; all being incorporated herein in their entirety; (g) gel or solid ceramics such as (g1) alumina, (g2) zirconia, (g3) carbon, (g4) titania, (g5) bioglass, or (g6) hydroxyapatite (HA); (h) composites such as (h1) silica/SR, (h2) CF/UHMWPE, (h3) CF/PTFE, (h4) HA/PE, (h5) CF/epoxy, (h6) CF/PEEK, (h7) CF/C or (h8) $Al_2O_3$/PTFE; (i) hydrogels such as (i1) polyisocyanopeptide hydrogels such as oligo(ethylene)glycol polyisocyanopeptides as described, for instance, in Van Buul, et al.; Chem. Sci. 4, 2357-2363 (2013), incorporated herein by reference in its entirety, (i2) polysaccharides such as alginates, chitosans, chitins, guar gums, pectins, gellan gums, heparins, carrageenans, hyaluronans, starches, agars, xanthan gums, methylcellulose, carboxymethylcellulose, hydroxypropyl methyl cellulose, (i3) polyglycols such as polyethyleneglycol or polypropyleneglycol, (i4) polyvinylpyrrolidone, (i5) poly (vinylalcohol), (i6) polyacrylic acids, (i7) glycerophosphates, (i8) 2-acrylamido-2-methylpropanesulfonic acid, (i9) polyphosphazenes; (j) other suitable materials such as demineralized bone matrix; and any combinations thereof.

Suitable sources of bioactive carriers for implementing embodiments of the present invention include, but are not limited to, autographs, allographs, xenographs, plants, solutions, excipients, ceramics, metals, metal alloys, organic and inorganic polymers, bioglasses, carbon-containing structures, or combination thereof.

Particularly suitable as bioactive carriers for implementing embodiments of the present invention include bioactive carriers comprising at least one naturally occurring hydroxyl group on at least one surface thereof and bioactive carriers which do not naturally comprise at least one hydroxyl group on a surface thereof but which have been modified using conventional surface treatment techniques such that at least one hydroxyl group is present on a surface of the bioactive carrier. In one example, said hydroxyl group is an available hydroxyl group i.e. it is not prevented from interacting and/or reacting with a compound of the present disclosure. Suitable as bioactive carriers naturally containing hydroxyl groups on a surface thereof for implementing embodiments of the invention specifically include metal oxides such as titanium oxides and non-metal oxides such ceramics. Also suitable as bioactive carriers for implementing embodiments of the invention include bioactive carriers comprising at least one naturally occurring carboxylate group (—COOH) or amine group (—$NH_2$) on at least one of a surface thereof and bioactive carriers which do not naturally comprise at least one carboxylate group (—COOH) or amine group (—$NH_2$) onto a surface thereof but which have been modified using conventional surface treatment techniques such that at least one carboxylate group (—COOH) or amine group (—$NH_2$) is present on a surface of the bioactive carrier.

In one example, said bioactive carrier includes a biomaterial. Suitable biomaterials for implementing certain embodiments of the present disclosure may be derived from nature or synthesized in the laboratory using a variety of chemical approaches utilizing metallic components, polymers, ceramics or composite materials. They are often used and/or adapted for a medical application, and thus comprise whole or part of a living structure or biomedical device. Suitable biomaterials for implementing certain embodiments of the present disclosure are commonly used in joint replacements, bone plates, bone cement, artificial ligaments and tendons, dental implants for tooth fixation, blood vessel prostheses, heart valves, skin repair devices (artificial tissue), cochlear replacements, contact lenses, breast implants, drug delivery mechanisms, sustainable materials, vascular grafts, stents, nerve conduits. Particularly suitable biomaterials for implementing certain embodiments of the present disclosure such as metals and alloys (pages 94-95), ceramics (pages 95-97), polymeric biomaterials (pages 97-98) and biocomposite materials (pages 98-99) are described in Nitesh et al., International Journal of Emerging Technology and Advanced Engineering, ISSN 2250-2459, Volume 2, Issue 4, 2012, which is herein incorporated by reference in its entirety.

In one particular example, said bioactive carrier is a biomaterial.

In certain embodiments, particularly suitable bioactive carriers are selected from the group consisting of bioinert biomaterials, bioactive biomaterials and bioresorbable biomaterials.

The nature of the biomaterial is an important parameter. Particularly good results have been obtained using bioactive carriers composed mostly with the main material component of the tissue to be regenerated and/or repaired. This generally allows for a better integration of the bioactive carrier, a better resorption from the surrounding cells already present and therefore a better regeneration or repair of the targeted tissue to be achieved. For example, it was discovered that particularly good results may be obtained when a solid ceramic component (granulated ceramic powder or ceramic scaffolds) or a gel ceramic component is used in combination of a GFR-binding peptide of the present disclosure to regenerate bone and protect from osteoporosis. For example, it was also discovered that particularly good results may be obtained when collagen, in particular collagen types I, II, III and XI, is used in combination of a GFR-binding peptide of the present disclosure to regenerate cartilage. For example, it was also discovered that particularly good results may be obtained when collagen, in particular collagen types I and III, or a biodegradable hydrogel is used in combination of a GFR-binding peptide of the present disclosure to regenerate muscle, skin, tendons and ligaments. For example, it was also discovered that particularly good results may be obtained when a collagen or a biodegradable hydrogel is used in combination of a GFR-binding peptide of the present disclosure to regenerate tissues and/or functions of vascular, neuron, eye retina, renal, wound healing, hair, fertility and reproduction, lung, and adipose tissues.

Bioinert biomaterials: As used herein, unless indicated otherwise or contradictory in context, the term "bioinert biomaterials" refers to any material that once placed in the human body has minimal interaction with its surrounding tissue. Examples of these are stainless steel, titanium, alumina, partially stabilised zirconia, and ultra-high molecular weight polyethylene. Generally a fibrous capsule might form around bioinert implants hence its biofunctionality relies on tissue integration through the implant.

Bioactive biomaterial: As used herein, unless indicated otherwise or contradictory in context, the term "bioactive biomaterial" refers to a material which, upon being placed within the human body, interacts with the surrounding bone and in some cases, even soft tissue. This occurs through a time-dependent kinetic modification of the surface, triggered by their implantation within the living bone. An ion-exchange reaction between the bioactive implant and surrounding body fluids, results in the formation of a biologically active carbonate apatite (CHAp) layer on the implant that is chemically and crystallographically equivalent to the mineral phase in bone. Examples of these materials are synthetic hydroxyapatite [$Ca_{10}(PO_4)_6(OH)_2$], glass ceramic A-W and Bioglass®.

Bioresorbable Biomaterials: As used herein, unless indicated otherwise or contradictory in context, the term "bioresorbable biomaterials" refers to a material which, upon placement within the human body, starts to dissolve (resorbed) and slowly replaced by advancing tissue (such as bone). Examples of bioresorbable materials include, but are not limited to, tricalcium phosphate [$Ca_3(PO_4)_2$], polylactic-polyglycolic acid copolymers, calcium oxide, calcium carbonate and gypsum.

Therefore, no particular limitation should be ascribed to the substance, material or molecule suitable as being bioactive carriers for implementing embodiments of the present invention insofar as said substance, material or molecule is (a) biocompatible as defined herein and (b) combinable or associable with a GFR-binding compound as defined herein. In one preferred example, said bioactive carrier has a stiffness of at least 5 kPa, more preferably at least 35 kPa and preferably not more than 3 or 5 GPa as measured using conventional Dynamic Mechanical Analysis such as described in details in Gong J P et al., Double-network hydrogels with extremely high mechanical strength, Adv Mater 2003, 15(14), 1155e8, which is incorporated herein by reference.

In one particular example, a biomaterial as defined herein for use in neuron-related applications has a stiffness comprised between about 0.01 kPa and about 3 kPa, preferably between about 0.01 kPa and about 1 kPa. In one particular example, a biomaterial as defined herein for use in muscle, cartilage and tendon/ligament-related applications has a stiffness comprised between about 3 kPa and about 200 kPa, preferably between about 10 kPa and about 30 kPa. In one particular example, a biomaterial as defined herein for use in bone-related applications has a stiffness comprised between about 30 kPa and about 3 GPa, preferably between about 70 kPa and about 200 kPa for instance in applications such as the treatment or prevention of osteoporosis and bone tissue regeneration. In one particular example, a biomaterial as defined herein for use in hair-related applications has a stiffness comprised between about 0.01 kPa and about 200 kPa, preferably between about 3 kPa and about 70 kPa. In one particular example, a biomaterial as defined herein for use in endothelization-related applications has a stiffness comprised between about 500 kPa and about 2.5 GPa. In one particular example, a biomaterial as defined herein for use in angiogenesis-related applications has a stiffness comprised between about 0.01 kPa and about 100 kPa. In one particular example, a biomaterial as defined herein for use in wound healing and skin-related applications has a stiffness comprised between about 0.01 kPa and about 70 kPa.

Available hydroxyl groups: As used herein, unless indicated otherwise or contradictory in context, the term "free hydroxyl" or "available hydroxyl" means an hydroxyl group, which may be —OH or a radical (—O·) or an anion (—O⁻) fully or partially ionised, which is able to/free to act as a nucleophile in a reaction with an electrophile such as compound (A) or compound (B) defined below.

Available hydroxyl-containing surface: As used herein, unless indicated otherwise or contradictory in context, the term "available hydroxyl-containing surface" or "free hydroxyl-containing surface" means a surface containing at least one free or available hydroxyl group as defined herein.

Ceramics: As used herein, unless indicated otherwise or contradictory in context, the term "ceramic" refers to an inorganic material with a high melting point, above 1000° C. Most typically, materials referred to as "ceramics" are obtained by a process in which raw material solid particles are heated in order to sinter them. Materials referred to as "ceramics" may broadly be split into two groups, these being "oxide ceramics" and "non-oxide ceramics". "Oxide ceramics" include, but are not limited to, alkaline earth oxides such as MgO and BaO, $Al_2O_3$ and aluminates, $TiO_2$ and titanates, $ZrO_2$ and zirconates, silicates such as clays and clay-derived materials. Since the term "ceramics" may encompass crystalline, partially amorphous and fully amorphous materials, the term "oxide ceramics" may also be interpreted as covering fully amorphous silicate glasses. "Non-oxide ceramics" include, but are not limited to, carbides and nitrides, and also borides and silicides, for example silicon carbide and silicon nitride, and also metal carbides and nitrides. In one particular example, solid ceramics e.g. in granulated powder or as a scaffold, is used as a bioactive carrier in the meaning of the present disclosure in bone-related applications. In one particular example, gel ceramics is used as a bioactive carrier in the meaning of the present disclosure in bone-related applications.

Metal oxides: As used herein, unless indicated otherwise or contradictory in context, the term "metal oxide" means a chemical compound that contains at least one oxygen atom and one other element in its chemical formula. Metal oxides typically contain an anion of oxygen in the oxidation state of −2. They can be obtained by hydrolysis or air/oxygen oxidation. Examples of such metal oxides are titanium oxides (e.g. TiO, $Ti_2O_3$, $TiO_2$), silicon oxide ($SiO_2$), aluminum oxide ($Al_2O_3$), iron (II, III) oxides such as $Fe_2O_3$, and zinc oxide (ZnO).

Biopolymer: As used herein, unless indicated otherwise or contradictory in context, the term "biopolymer" refers to a polymer produced by living organisms and includes, but is not limited to, polypeptides and proteins (such as collagen and fibrin), polysaccharides (such as cellulose, starch, chitin and chitosan), nucleic acids (such as DNA and RNA), and hydrides thereof.

Hydrogel: As used herein, unless indicated otherwise or contradictory in context, the term "hydrogel" refers to "Hydrogel" refers to a class of polymeric materials which are swollen in an aqueous medium, but which do not dissolve in water. Hydrogels are highly absorbent (they can contain over 99% water) natural or synthetic polymers. Hydrogels also possess a degree of flexibility very similar to natural tissue, due to their significant water content. U.S. Pat. No. 6,475,516, for example, provides hydrogels being covalently bound to the surface of an in-dwelling medical device such as an implant, which may be functionalized with a GFR-binding compound of the present disclosure using, for instance, a process as described herein. In one particular example, biodegradable hydrogels are used as bioactive carriers in the meaning of the present disclosure.

Collagen: As used herein, unless indicated otherwise or contradictory in context, the term "collagen" refers to the main structural protein of the various connective tissues in animals which is mostly found in fibrous tissues such as tendons, ligaments and skin, and is also abundant in corneas, cartilage, bones, blood vessels, the gut, and intervertebral discs. Collagen is typically composed of a triple helix and generally contains high hydroxyproline content. The most common motifs in its amino acid sequence glycine-proline-X and glycine-X-hydroxyproline, where X is any amino acid other than glycine, proline or hydroxyproline. 28 types of collagen have been identified and described in the literature, which are all presently contemplated to be suitable for implementing embodiments of the invention. The five most common types are: Collagen I which may be found in skin, tendon, vascular ligature, organs, bone (main component of the organic part of bone); Collagen II which may be found in cartilage (main component of cartilage); Collagen III which may be found in reticulate (main component of reticular fibers); Collagen IV which may be found in the basal lamina, the epithelium-secreted layer of the basement membrane; Collagen V which may be found on cell surfaces, hair and placenta. For example, in certain embodiments, suitable collagens for implementing embodiments of the present invention particularly include collagen type-I and type-IV. In one particular example, collagen, in particular collagen types I, II, III and XI, is used as a bioactive carrier in the meaning of the present disclosure in cartilage-related applications. In one particular example, collagen, in particular collagen types I and III, is used as a bioactive carrier in the meaning of the present disclosure in muscle-related applications, skin-related applications, and T/L-related applications. In one particular example, any type of collagen is used as a bioactive carrier in the meaning of the present disclosure in vascular, neuron, eye retina, renal, wound healing, hair, fertility and reproduction, lung, adipose-related applications.

In certain embodiments, said association, combination, linkage or connection between said GFR-binding compound and a bioactive carrier may occur via a bioactive carrier-affinity-containing group as defined herein.

IV. Bioactive Carrier-Affinity-Containing Atom)

In one aspect, the present disclosure provides a GFR-binding compound as already defined herein modified or functionalised with at least one bioactive carrier-affinity-containing group. Said at least one bioactive carrier-affinity-containing group provides said GFR-binding compound with the ability to, covalently or non-covalently, interact with, or be connected to, a bioactive carrier as defined herein (in particular, a biomaterial as defined herein).

In such embodiments where affinity is required via covalent interaction or binding, said bioactive carrier-affinity-containing group may be a thiol (SH)-containing group or a cysteine-containing group, in particular, a thiol (SH)-containing peptide or a cysteine-containing peptide. In such embodiments where affinity is required via covalent interaction or binding, said bioactive carrier-affinity-containing group may particularly be a cysteine.

In such embodiments where affinity is required via non-covalent interaction or binding, said bioactive carrier-affinity-containing group may comprise (or be) a peptide group such as any one of the peptide groups disclosed in US patent application No. 2008/0268015 A1, which is hereby incorporated by reference in its entirety. In particular, peptides containing amino acid sequences rich in large aromatic amino acid residues (aromatic amino acid-containing peptides or peptidomimetics) that include one or more of Phe, Trp, Tyr such as sequences no: 1 to 45 described in US 2008/0268015 A1 are suitable as a biomaterial-affinity-containing fragment for implementing embodiments of the present invention. Said fragment may also be a peptide fragment such as any one of the peptide fragments disclosed in U.S. Pat. No. 6,818,620 B2, which is hereby incorporated by reference in its entirety. In particular, peptides of sequences no: 1 to 7 described in U.S. Pat. No. 6,818,620 B2 are suitable as a biomaterial-affinity-containing fragment for implementing embodiments of the present invention.

In one particular example, said bioactive carrier-affinity-containing group is a bioactive carrier high-affinity-containing group such as a biomaterial high-affinity-containing group.

In certain embodiments, said bioactive carrier-affinity-containing group has some affinity (preferably high affinity) with a given bioactive carrier (in particular, a biomaterial) such as collagen, apatite, titanium or any of those listed in e.g. US patent application No. 2008/0268015 A1, which is incorporated herein by reference. For instance, a group having some affinity with a biomaterial is any group capable to non-covalently interact/bind to a biomaterial with an affinity/specificity selected from at least 10%, at least 20%, at least 30%, at least 40%, at least 50%, at least 60%, at least 70%, at least 80%, at least 90%, at least 100%, at least 200%, at least 300%, at least 400%, at least 500%, or a higher percentage, with respect to an affinity where said group binds to an appropriate control such as, for example, a different material or surface, or a protein typically used for such comparisons such as bovine serum albumin. In one example, a biomaterial-affinity-containing group has a binding specificity that is characterized by a relative binding affinity as measured by an EC50 of 10 µM or less, and in certain embodiments, less than 1 µM. In certain embodiments, a relative affinity comprised between 1 pM and 100 µM, between 1 pM and 10 µM, or between 1 pM and 1 µM is particularly suitable. The EC50 is determined using any number of methods known in the art. In this case, the EC50 represents the concentration of fragment producing 50% of the maximal binding observed for that fragment in the assay.

In one particular example, said bioactive carrier-affinity-containing group is selected from the group consisting of GTPGP (SEQ ID NO: 6610), which may preferably non-covalently interact with a bioactive carrier such as an apatite, and WWFWG (SEQ ID NO: 6611), which may preferably non-covalently interact with a bioactive carrier such as a collagen.

In one particular example, said bioactive carrier-affinity-containing group is covalently or non-covalently (in particular, covalently) attached at an end (or extremity) of said GFR-binding compound.

V. Modified GFR-Binding Compound

Thus, in one aspect, the present disclosure provides a modified GFR-binding compound comprising a GFR-binding compound as defined in the present disclosure and a bioactive carrier-affinity-containing group; and wherein the RMSD of the GFR-binding compound is 2.45 Å or less.

For example, in certain embodiments, the present disclosure provides a modified GFR-binding compound comprising a GFR-binding compound as defined in the present disclosure and a bioactive carrier-affinity-containing group; wherein said bioactive carrier-affinity-containing group is selected from the group consisting of a thiol-containing group (in particular, a thiol-containing peptide), a cysteine-containing group (in particular, a cysteine-containing peptide and more particularly, a cysteine), and an aromatic amino acid-containing peptide or peptidomimetic; and wherein the RMSD of the GFR-binding compound is 2.45 Å or less.

For example, in certain embodiments, the present disclosure provides a modified GFR-binding compound comprising a GFR-binding compound and a bioactive carrier-affinity-containing group; wherein said GFR-binding compound is a peptide, a variant or analog thereof, or a peptidomimetic as defined herein, with (comprising, or exclusively consisting of, or constituted of) between 8-30 amino acids, in particular between 8-25 amino acids or between 8-22 amino acids, more particularly between 18-22 amino acids, even more particularly between 19-21 or 20, comprising a peptide with four amino acids (PEP1) selected from the group consisting of SAIS (SEQ ID NO: 6360), SSLS (SEQ ID NO: 6365), NAIS (SEQ ID NO: 6357), SATS (SEQ ID NO: 6361), SPIS (SEQ ID NO: 6364), EPIS (SEQ ID NO: 6353), SPIN (SEQ ID NO: 6363), KPLS (SEQ ID NO: 6356), EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358); wherein said bioactive carrier-affinity-containing group is selected from the group consisting of a thiol-containing group (in particular, a thiol-containing peptide), a cysteine-containing group (in particular, a cysteine-containing peptide and more particularly, a cysteine), and an aromatic amino acid-containing peptide or peptidomimetic; and wherein the RMSD of the GFR-binding compound is 2.45 Å or less.

For example, in certain embodiments, the present disclosure provides a modified GFR-binding compound comprising a GFR-binding compound and a bioactive carrier-affinity-containing group; wherein said GFR-binding compound is a peptide, a variant or analog thereof, or a peptidomimetic as defined herein, with (comprising, or exclusively consisting of, or constituted of) between 8-30 amino acids, in particular between 8-25 amino acids or between 8-22 amino acids, more particularly between 18-22 amino acids, even more particularly between 19-21 or 20, comprising a peptide with height amino acids of general formula (PEP12): PEP1-$AA^{17}$-PEP11; wherein PEP1 is a peptide with four amino acids selected from the group consisting of SAIS (SEQ ID NO: 6360), SSLS (SEQ ID NO: 6365), NAIS (SEQ ID NO: 6357), SATS (SEQ ID NO: 6361), SPIS (SEQ ID NO: 6364), EPIS (SEQ ID NO: 6353), SPIN (SEQ ID NO: 6363), KPLS (SEQ ID NO: 6356), EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358); wherein PEP11 is a peptide with 3 amino acids of formula $AA^{18}$-$AA^{19}$-$AA^{20}$; wherein $AA^{17}$ is selected from the group consisting of G, A, V, L, I, P, F, M, W, T and S (in particular is selected from the group consisting of M, I, L, V and T); wherein $AA^{18}$ is selected from the group consisting of L, V, Q, A and R; wherein $AA^{19}$ is selected from the group consisting of F, W, H and Y (in particular is an aromatic, polar amino acid such as Y); wherein $AA^{20}$ is selected from the group consisting of L, F, Y, K, I, V and M; wherein said bioactive carrier-affinity-containing group is selected from the group consisting of a thiol-containing group (in particular, a thiol-containing peptide), a cysteine-containing group (in particular, a cysteine-containing peptide and more particularly, a cysteine), and an aromatic amino acid-containing peptide or peptidomimetic; and wherein the RMSD of the GFR-binding compound is 2.45 Å or less.

For example, in certain embodiments, the present disclosure provides a modified GFR-binding compound comprising a GFR-binding compound and a bioactive carrier-affinity-containing group; wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (I) (hereinafter may also be referred to as compound (I) or peptide (I)):

PEP(C)-PEP12 (I)

wherein PEP12 is a peptide with 8 amino acids of formula PEP1-$AA^{17}$-PEP11 as defined herein; wherein one end of PEP(C) interacts covalently with PEP12 via one end of PEP1; wherein PEP(C) is a peptide with at least 5 amino acids, in particular a peptide with between 5 and 12 amino acids; wherein said bioactive carrier-affinity-containing group is selected from the group consisting of a thiol-containing group (in particular, a thiol-containing peptide), a cysteine-containing group (in particular, a cysteine-containing peptide and more particularly, a cysteine), and an aromatic amino acid-containing peptide or peptidomimetic; and wherein the RMSD of the GFR-binding compound is 2.45 Å or less.

For example, in certain embodiments, the present disclosure provides a modified GFR-binding compound comprising a GFR-binding compound and a bioactive carrier-affinity-containing group; wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (II) (hereinafter may also be referred to as compound (II) or peptide (II)):

PEP7-PEP5-PEP12 (II)

wherein PEP12 is a peptide with 8 amino acids of formula PEP1-$AA^{17}$-PEP11 as defined herein; wherein PEP5 is a peptide with five amino acids as defined herein; wherein PEP7 is an amino acid or a peptide with between two and seven amino acids as defined herein; wherein one end of PEP5 interacts covalently with one end of PEP12 via one end of PEP1; wherein another end of PEP5 interacts covalently with one end of PEP7 via $AA^7$; wherein said bioactive carrier-affinity-containing group is selected from the group consisting of a thiol-containing group (in particular, a thiol-containing peptide), a cysteine-containing group (in particular, a cysteine-containing peptide and more particularly, a cysteine), and an aromatic amino acid-containing peptide or peptidomimetic; and wherein the RMSD of the GFR-binding compound is 2.45 Å or less.

For example, in certain embodiments, the present disclosure provides a modified GFR-binding compound comprising a GFR-binding compound and a bioactive carrier-affinity-containing group; wherein said GFR-binding compound is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (III) (hereinafter may also be referred to as compound (III) or peptide (III)):

$AA^1$-$AA^2$-$AA^3$-$AA^4$-$AA^5$-$AA^6$-$AA^7$-$AA^8$-$AA^9$-$AA^{10}$-$AA^{11}$-$AA^{12}$-$AA^{13}$-$AA^{14}$-$AA^{15}$-$AA^{16}$-$AA^{17}$-$AA^{18}$-$AA^{19}$-$AA^{20}$ (III)

wherein $AA^1$-$AA^2$-$AA^3$-$AA^4$-$AA^5$-$AA^6$-$AA^7$ (SEQ ID NO: 6606) is PEP7 as defined herein; wherein $AA^{13}$-$AA^{14}$-$AA^{15}$-$AA^{16}$-$AA^{17}$-$AA^{18}$-$AA^{19}$-$AA^{20}$ is PEP12 as defined herein; wherein $AA^8$-$AA^9$-$AA^{10}$ is PEP3 as defined herein; wherein $AA^{11}$ and $AA^{12}$ are as defined herein; wherein $AA^1$ may be an N-terminal amino acid or a C-terminal amino acid; wherein $AA^{20}$ may be an N-terminal amino acid or a C-terminal amino acid; wherein said bioactive carrier-affinity-containing group is selected from the group consisting of a thiol-containing group (in particular, a thiol-containing peptide), a cysteine-containing group (in particular, a cysteine-containing peptide and more particularly, a cysteine), and an aromatic amino acid-containing peptide or peptidomimetic; and wherein the RMSD of the GFR-binding compound is 2.45 Å or less.

VI. Functionalised Bioactive Carriers

In one aspect, the present disclosure provides a functionalised bioactive carrier, which may be used for inducing, in-vitro, ex-vivo or in-vivo, tissue regeneration, comprising at least one GFR-binding compound (in particular, at least one modified GFR-binding compound) as defined in the present disclosure. In one example, said (modified) GFR-binding compound and bioactive carrier are both active principles/ingredients. In certain embodiments, said functionalised bioactive carrier is a modified, functionalised, coated or grafted biomaterial as defined herein, in particular, a modified, functionalised, coated or grafted tissue regeneration compatible-biomaterial.

In one example, said functionalised bioactive carrier comprises one (modified) GFR-binding compound. In one example, said functionalised bioactive carrier comprises two or more distinct (modified) GFR-binding compounds. In one example, said functionalised bioactive carrier comprises three or more distinct (modified) GFR-binding compounds. In one example, said functionalised bioactive carrier comprises four or more distinct (modified) GFR-binding compounds.

Active or bioactive principles or ingredients: In the present description and unless otherwise indicated or contradictory in context, the term "(bio)active principle" or "(bio) active ingredient" generally refers to a molecule, compound or substance which is responsible for providing the desired biological effect. Without said active ingredient, the formulation or composition containing it, would not provide the desired biological effect. For example, in certain embodiments, formulation excipients are not considered as active ingredients in the pharmaceutical composition as defined herein.

In one example, said functionalised bioactive carrier is formed using a method comprising, or exclusively consisting of, contacting a bioactive carrier as defined herein and a (modified) GFR-binding compound under reacting conditions thereby functionalizing at least one part (or at least one part of a surface) of said bioactive carrier and thus forming a functional association, interaction or bond between said bioactive carrier and said (modified) GFR-binding compound.

In the present description and unless otherwise indicated or contradictory in context, the terms "functionally associated", "functionally combined", "functionalized", "immobilized", "deposited", "coated", or "grafted" all refer to the action of associating or functionalising at least one part of a bioactive carrier with a (modified) GFR-binding compound so that the desired biological, therapeutic and/or cosmetic effect e.g. inducing tissue formation, is obtained. The association or combination may be covalent and form, between said (modified) GFR-binding compound and said bioactive carrier, a covalent interaction as already defined herein, or, the association or combination may be non-covalent and form, between said (modified) GFR-binding compound and said bioactive carrier, a non-covalent interaction as already defined herein.

For example, in certain embodiments, a (modified) GFR-binding compound interacts covalently (makes at least one functional covalent interaction) with said bioactive carrier.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, having growth factor receptor-binding capability or capabilities, having a molecular weight of between 600-4,000 Da, 600-3,000 Da, or 800-4,000 Da, in particular between 800 and 3,000 Da; and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, having growth factor receptor-binding capability or capabilities, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with three amino acids (PEP3); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); wherein said GFR-binding compound further comprises a peptide with three amino acids (PEP3); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of)

between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with five amino acids (PEP5); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); wherein said GFR-binding compound further comprises a peptide with five amino acids (PEP5); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with between six and twelve amino acids (PEP9); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with eight amino acids (PEP12); wherein said GFR-binding compound further comprises a peptide with between six and twelve amino acids (PEP9); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with three amino acids (PEP3), an amino acid or a peptide with between two and seven amino acids (PEP7); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP12); wherein said GFR-binding compound further comprises a peptide with three amino acids (PEP3), an amino acid or a peptide with between two and seven amino acids (PEP7); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP1); wherein said GFR-binding compound further comprises a peptide with five amino acids (PEP5), an amino acid or a peptide with between two and seven amino acids (PEP7); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, comprising a peptide with four amino acids (PEP12); wherein said GFR-binding compound further comprises a peptide with five amino acids (PEP5), an amino acid or a peptide with between two and seven amino acids (PEP7); and wherein the RMSD is 2.45 Å or less.

In one aspect, the present disclosure provides a functionalised bioactive carrier comprising a (modified) GFR-binding compound, wherein said (modified) GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (I) (hereinafter may also be referred to as compound (I) or peptide (I)):

PEP(C)-PEP12     (I)

wherein PEP12 is a peptide with 8 amino acids of formula PEP1-AA$^{17}$-PEP11 as defined herein; wherein one end of PEP(C) interacts covalently with PEP12 via one end of PEP1; wherein PEP(C) is a peptide with at least 5 amino acids, in particular a peptide with between 5 and 12 amino acids; and wherein the RMSD is 2.45 Å or less.

In one aspect, the present disclosure provides a functionalised bioactive carrier comprising a (modified) GFR-binding compound of general formula (I), wherein PEP(C) comprises PEP3; and wherein the RMSD is 2.45 Å or less.

In one aspect, the present disclosure provides a functionalised bioactive carrier comprising a (modified) GFR-binding compound of general formula (I), wherein PEP(C) comprises PEP5; and wherein the RMSD is 2.45 Å or less. In one particular example, PEP(C) is PEP5.

In one aspect, the present disclosure provides a functionalised bioactive carrier comprising a (modified) GFR-binding compound of general formula (I), wherein PEP(C) comprises PEP9; and wherein the RMSD is 2.45 Å or less. In one particular example, PEP(C) is PEP9.

In one aspect, the present disclosure provides a functionalised bioactive carrier comprising a (modified) GFR-binding compound of general formula (I), wherein PEP(C) comprises PEP3 and PEP7; and wherein the RMSD is 2.45 Å or less.

In one aspect, the present disclosure provides a functionalised bioactive carrier comprising a (modified) GFR-binding compound of general formula (I), wherein PEP(C) comprises PEP5 and PEP7; and wherein the RMSD is 2.45 Å or less.

In one aspect, the present disclosure provides a functionalised bioactive carrier comprising a (modified) GFR-binding compound, wherein said GFR-binding compound (before any modifications) is a peptide, a variant or analog thereof, or a peptidomimetic as defined herein, with (comprising, or exclusively consisting of, or constituted of) between 8 and 30 (in particular between 8-25 or between 8-22, more particularly between 18-22, even more particularly between 19-21 or 20) amino acids, having the following general formula (II) (hereinafter may also be referred to as compound (II) or peptide (II)):

$$\text{PEP7-PEP5-PEP12} \quad (II)$$

wherein PEP12 is a peptide with 8 amino acids of formula PEP1-AA$^{17}$-PEP11 as defined herein; wherein PEP5 is a peptide with five amino acids as defined herein; wherein PEP7 is an amino acid or a peptide with between two and seven amino acids as defined herein; wherein one end of PEP5 interacts covalently with one end of PEP12 via one end of PEP1; wherein another end of PEP5 interacts covalently with one end of PEP7 via AA$^7$; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptide, a variant or analog thereof, with between 18-22 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptidomimetic comprising between 18-22 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptide, a variant or analog thereof, with between 19-21 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptidomimetic comprising between 19-21 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptide, a variant or analog thereof, with 21 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptidomimetic comprising 21 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptide, a variant or analog thereof, with 20 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one particular aspect, the present disclosure provides a functionalised biomaterial comprising a (modified) GFR-binding compound; wherein said biomaterial is as defined herein; wherein said (modified) GFR-binding compound (before any modifications) is a peptidomimetic comprising 20 amino acids comprising a peptide PEP1 or a peptide PEP12, and a peptide PEP3 or a peptide PEP5; wherein said (modified) GFR-binding compound optionally further comprises a peptide PEP7; and wherein the RMSD is 2.45 Å or less.

In one aspect, the present disclosure provides a functionalised bioactive carrier comprising a (modified) GFR-binding compound, wherein said GFR-binding compounds may be any one of or a plurality of peptides of SEQ ID NO: 1 to 1085 and 1143 to 6352.

The present disclosure provides a functionalised bioactive carrier comprising a (modified) GFR-binding compound, wherein all of PEP1, PEP3, PEP5, PEP9, PEP11, PEP12 and AA$^{17}$, pairs and triplets thereof, disclaimers and provisos, are as already defined herein.

Suitable covalent association or functionalization techniques for implementing embodiments of the present invention include, but are not limited to, reductive amination coupling or photo-grafting such as described in H. Freichel et al., Macromol. Rapid Commun. 2011, 32, 616-621 and V. Pourcelle et al., Biomacromol. 2009, 10, 966-974, the content of which is hereby incorporated by reference in its entirety.

In one aspect, the present disclosure provides a production method or process useful for producing a functionalised bioactive carrier according to the present disclosure wherein said bioactive carrier is a biomaterial such as a ceramic or a titanium, comprising, or exclusively consisting of, the contacting of a compound of formula (C-I) and a bioactive carrier as defined herein under suitable covalent-bond formation conditions thereby forming at least one covalent bond between said compound (C-I) and said bioactive carrier thus forming a functionalised bioactive carrier according to the present disclosure:

(C-I)

wherein X is Si; wherein Y is a divalent organic linker; wherein A is a (modified) GFR-binding compound according to the present disclosure, wherein $R^1$ and $R^2$ are both independently an organic spacing-compound other than a leaving group as defined herein, and wherein $R^3$ is a leaving group as defined herein;

In one particular example, a process or method which may be used to functionally associate or combine a (modified) GFR-binding compound with a bioactive carrier such as a ceramic or a titanium is shown in Scheme 1:

GFR-binding compound onto a polyetheretherketone polymer (PEEK) surface wherein (i) the polymer is treated with ethylene diamine ($NH_2$=$NH_2$) to create $NH_2$ functions on a PEEK surface from ketone (=O) functions and (ii) the hereby modified PEEK-$NH_2$ polymer is immersed in a solution of a chosen hetero-bifunctional cross-linker such as 3-succinimidyl-3-maleimidopropionate thereby reacting the maleimide group with a (modified) GFR-binding compound through e.g. a thiol group thereof.

In one particular example, a process or method which may be used to functionally associate or combine a (modified) GFR-binding compound with a bioactive carrier is a method for covalent functionalization or depositing of a (modified) GFR-binding compound onto a polylactic acid (PLLA) polymer wherein (i) the polymer is immersed in a solution containing, for instance, (dimethylaminopropyl)-3-ethylcarbodiimide hydrochloride+N-hydroxysuccinimide in (2-(N-morpholino)-ethanesulfonic acid and then (ii) rinsed using e.g. MilliQ water.

Leaving groups: As used herein, unless indicated otherwise or contradictory in context, the term "leaving group" means a molecular fragment which possesses the ability to depart with a pair of electrons in a heterolytic bond cleavage. Leaving groups are anions or neutral molecules and possess the ability to stabilize the additional electron density that results from bond heterolysis. Common anionic leaving groups are halogen atoms such as chlorine (Cl), bromine (Br), and iodine (I), which leaves as a chloride ion ($Cl^-$), a Scheme 1

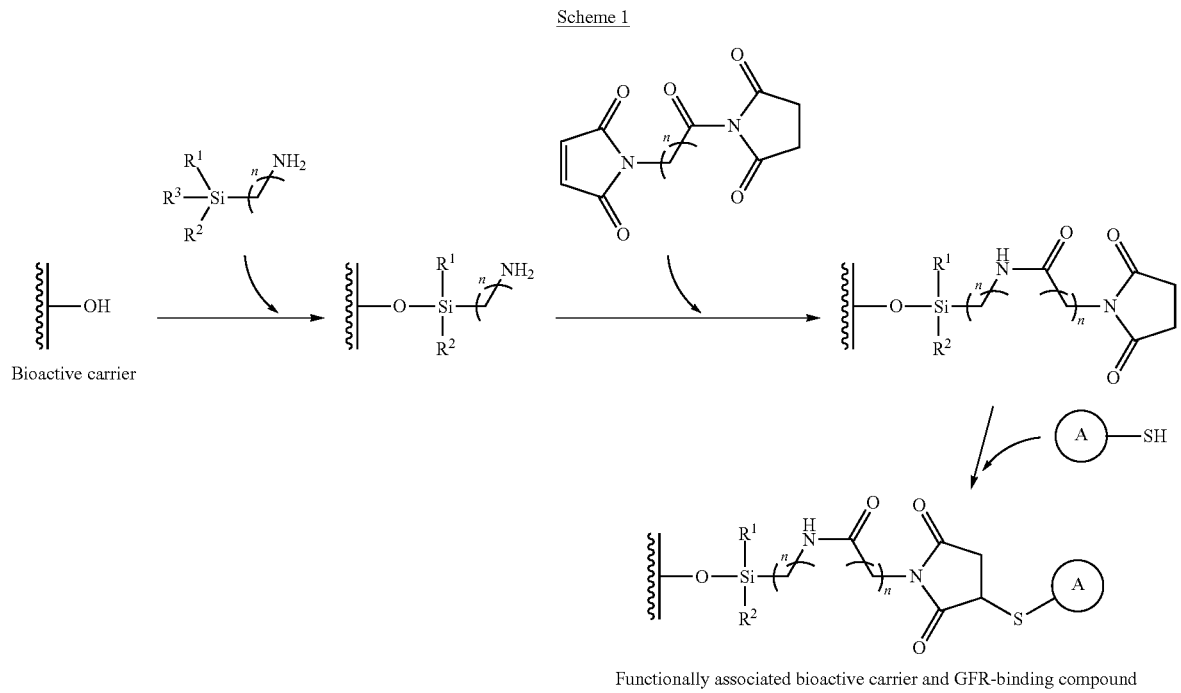

Functionally associated bioactive carrier and GFR-binding compound

Such syntheses involve the formation of a covalent interaction (or association) between a (modified) GFR-binding compound (represented as (A)-SH in Scheme 1) and a bioactive carrier as defined herein.

In one particular example, a process or method which may be used to functionally associate or combine a (modified) GFR-binding compound with a bioactive carrier is a method for covalent functionalization or depositing of a (modified)

bromide ion (Br) and an iodide ion ($I^-$), respectively. Other leaving groups include sulfonate esters, such as tosylate ($TsO^-$). Conventional neutral molecule leaving groups are water and ammonia. Suitable as leaving groups for implementing embodiments of the invention preferably include the group consisting of a halogen, a substituted or unsubstituted alkoxy group (—OR), a substituted or unsubstituted aryloxy or heteroaryloxy group (—OAr), a substituted or unsubstituted alkylcarbonyloxy group (—O₂CR), a substituted or unsubstituted arylcarbonyloxy or heteroarylcarbonyloxy group (—O₂CAr), a substituted or unsubstituted alkylsulfonyloxy group (—O₃SR), a substituted or unsubstituted arylsulfonyloxy or heteroarylsulfonyloxy group (—O₃SAr). Substituents of leaving groups include halogens, alkyl (preferably C1 to C5-alkyl) groups and alkoxy (preferably C1 to C5-alkoxy) groups.

Y Group

In the present disclosure, the Y group is not aimed at being particularly limited and any moiety comprising at least one atom and having the ability to covalently or non-covalently, preferably covalently, link or interact with the X and A groups as defined herein thereby providing a stable connection between an active substance A and the X group as defined herein, is, unless contradictory or non-adapted in context, suitable for implementing embodiments of the present disclosure and is comprised within the scope of the invention.

Thus, in the present description and unless otherwise indicated, the term "linker", when used in relation to a Y group, means any organic moiety comprising at least one atom and having the ability to interact covalently or non-covalently with an active substance A and covalently interact with an X group as defined herein.

In one example, Y groups include divalent organic radicals selected from the group consisting of a saturated or unsaturated, preferably saturated, hydrocarbon chain comprising between 1 and 30 carbon atoms, wherein said hydrocarbon chain is optionally interrupted by one or more non-carbon atom, preferably between 1 and 16, between 1 and 12 or between 1 and 8 non-carbon atoms as appropriate, wherein said non-carbon atom is selected, for instance, from the group consisting of —O—, —S—, —C(=O), —SO₂—, —N(Ri)(C=O)—, —N(Ri)-, and the following radical:

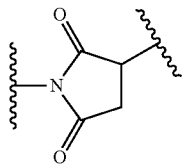

wherein Ri is selected from the group consisting of a hydrogen atom, a C1-C6 alkyl group and a aryl group, and wherein said hydrocarbon chain is non-substituted or substituted, by at least one radical selected from the group consisting of a halogen, a hydroxyl group, a C1-C20 alkyl group and a aryl group.

Suitable as Y groups for implementing embodiments of the invention include saturated or unsaturated hydrocarbon chains comprising between 1 and 20 carbon atoms, saturated or unsaturated hydrocarbon chains comprising between 1 and 10 carbon atoms, saturated or unsaturated hydrocarbon chains comprising between 1 and 5 carbon atoms, saturated or unsaturated hydrocarbon chains comprising 1, 2 or 3 carbon atoms, all of which being specifically and individually preferred.

Also suitable as Y groups for implementing embodiments of the invention include saturated or unsaturated hydrocarbon chains comprising between 1 and 20 carbon atoms, saturated or unsaturated hydrocarbon chains comprising between 1 and 10 carbon atoms, saturated or unsaturated hydrocarbon chains comprising between 1 and 5 carbon atoms, saturated or unsaturated hydrocarbon chains comprising 1, 2 or 3 carbon atoms, and in which said hydrocarbon chain is optionally interrupted by one or more, preferably between 1 and 16, between 1 and 12 or between 1 and 8, non-carbon atom, selected from the group consisting of an oxygen atom, a nitrogen atom, a carbonyl group and/or the following radical:

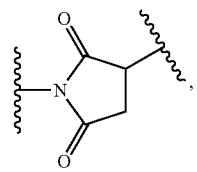 [SMILES: *C1CC(=O)N(*)C1=O]

all of which being specifically preferred and individually contemplated.

Also suitable as Y groups for implementing embodiments of the invention is:

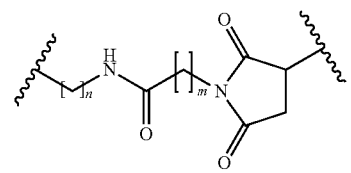

wherein n is comprised between 1 and 29, in particular between 1 and 5; and wherein m is comprised between 1 and 29, in particular between 1 and 5.

Suitable covalent-bond formation conditions: As used herein, unless indicated otherwise or contradictory in context, the term "suitable covalent-bond formation conditions" means reaction conditions such as pressure, temperature, reagent quantities, solvent's type and quantity, or stirring, under which starting materials may contact and provide at least one further material resulting from the formation of at least one covalent bond between said starting materials. Suitable as covalent-bond formation conditions for implementing embodiments of the present invention preferably include substantially atmospheric conditions.

Organic spacing-compound: In the present description and unless otherwise indicated, the term "organic spacing compound" means an organic chemical radical (preferably monofunctional radical) having the ability to create a steric effect/hindrance and/or electronic effect/hindrance in a direct vicinity of a (modified) GFR-binding compound of the present disclosure. Suitable organic spacing compounds include, but are not limited to, monovalent organic radicals independently selected from the group consisting of a saturated or unsaturated hydrocarbon chain of at most 20 nanometres (nm) in length, preferably at most 10 nm, 5 nm, 1 nm, 0.5 nm, 0.1 nm, 0.05 nm or 0.01 nm, wherein said hydrocarbon chain is optionally interrupted by one or more, preferably between 1 and 16, between 1 and 12 or between 1 and 8 non-carbon atoms as appropriate, wherein said non-carbon atom is selected from the group consisting of —O—, —S—, —C(=O), —SO₂—, —N(R)(C=O)—, and —N(R)—, wherein $R^i$ is selected from the group consisting of a hydrogen atom, a C1-C6 alkyl group and an aryl group, and wherein said hydrocarbon chain is non-substituted or substituted by at least one radical selected from the group consisting of a halogen, a hydroxyl group, a C1-C20 alkyl group and an aryl group. In particular, organic spacing compounds include saturated or unsaturated hydrocarbon chains comprising between 1 and 80 carbon atoms, saturated or unsaturated hydrocarbon chains comprising between 1 and 60 carbon atoms, saturated or unsaturated hydrocarbon chains comprising between 1 and 40 carbon atoms, saturated or unsaturated hydrocarbon chains comprising between 1 and 20 carbon atoms, saturated or unsaturated hydrocarbon chains comprising between 1 and 10 carbon atoms, saturated hydrocarbon chains comprising 1, 2, 3, 4, 5 or 6 carbon atoms, all of which being specifically and individually preferred. In one example, the saturated hydrocarbon chain may be methyl, ethyl, propyl, butyl or pentyl. In one example, said unsaturated hydrocarbon chain may be ethylene, propene, 1- or 2-butene, 1-, 2- or 3-pentene, acetylene, propyne, 1- or 2-butyne, 1-, 2- or 3-pentyne.

Saturated hydrocarbon chain: In the present description and unless otherwise indicated, the terms "saturated hydrocarbon chain" means a chain of carbon atoms linked together by single bonds and has hydrogen atoms filling all of the other bonding orbitals of the carbon atoms.

Unsaturated hydrocarbon chain: In the present description and unless otherwise indicated, the terms "unsaturated hydrocarbon chain" means a chain of carbon that contains carbon-carbon double bonds or triple bonds, such as those found in alkenes or alkynes, respectively.

Atmospheric conditions: As used herein, unless indicated otherwise or contradictory in context, the term "atmospheric conditions" or "ambient conditions", which are interchangeably used, refers to conditions which may be found naturally at an experimentation location. For example, in certain embodiments, typical atmospheric conditions in a chemistry/biology laboratory are a temperature of between about 15° C. and about 35° C. and a pressure of about 1 atm.

Solution: As used herein, unless indicated otherwise or contradictory in context, the term "solution" means a homogeneous mixture composed of only one phase, which is stable, which does not allow beam of light to scatter, in which the particles of solute cannot be seen by naked eye and from which a solute cannot be separated by filtration.

Suspension: As used herein, unless indicated otherwise or contradictory in context, the term "suspension" means a heterogeneous mixture containing solid particles that are sufficiently large for sedimentation. Typically, said solid particles are larger than one micrometer. In general, the internal phase (solid) is dispersed throughout the external phase (fluid) through mechanical agitation, with the use of certain excipients or suspending agents.

Suitable non-covalent association or functionalization techniques for implementing embodiments of the present invention include, but are not limited to, association(s) between a bioactive carrier-affinity containing group as already defined herein and at least part of a bioactive carrier. Such association(s) involves the formation of at least one non-covalent interaction (or attachment) between a (modified) GFR-binding compound and a bioactive carrier as defined herein.

In one example, said functionalised bioactive carrier is functionally associated with at least two, at least three, at least four, at least five, at least six, at least seven, at least eight, at least nine or at least ten (modified) GFR-binding compounds, each possessing a different and distinct chemical structure.

In one example, said functionalised bioactive carrier does not comprise a layer of polysiloxane.

For example, in certain embodiments, a functionalised bioactive carrier as defined herein comprises at least one (modified) GFR-binding compound, and at least one bioactive carrier, wherein said bioactive carrier:

has a porosity (or average pore diameter) comprised between 1 nm and 1000 µm, as measured by scanning electronic microscopy for pore sizes within the supra-nanometre range and by atomic force microscopy for pore sizes within the nanometre range, and/or comprises a stiffness of at least 5 kPa, preferably at least 35 kPa, as measured by Dynamic Mechanical Analysis, and/or is selected from the group consisting of biopolymers (collagen, fibrin, . . . etc), synthetic polymers (PEEK, PET, . . . etc), solid materials (Titanium, Metals . . . etc) and ceramics (Hydroxyapatite, Beta-tricalcium Phosphate, Biphasic Calcium Phosphate . . . etc), and/or
- comprises a density or concentration of associated compound (I) comprised between $0.05\times10^{-12}$ mol/mm$^2$ and $50\times10^{-12}$ mol/mm$^2$, as measured by conventional fluorescence microscopy or calculated theoretically on the basis of the peptide size, and/or
- does not comprise a layer of polysiloxane.

Porosity: As used herein, unless indicated otherwise or contradictory in context, the term "porosity" refers to the measure of the void spaces in a substance or material, and is a fraction of the volume of voids over the total volume, between 0 and 1, or as a percentage between 0 and 100%. There are many ways to test and measure the porosity of a substance or material, but for the purpose of the present disclosure, and for the avoidance of any doubts, porosity values are provided in manometers (nm) as obtained using atomic force microscopy for small pore diameters (up to 100 nm) and scanning electron microscopy for larger pore sizes.

Stiffness: As used herein, unless indicated otherwise or contradictory in context, the term "stiffness" refers to the rigidity of a substance or material i.e. the extent to which it resists deformation in response to an applied force. There are many ways to test and measure the stiffness of a substance or material, but for the purpose of the present disclosure, and for the avoidance of any doubts, stiffness values are provided in Pascal (Pa) as obtained using Dynamic Mechanical Analysis (DMA). Particularly preferred stiffness values are comprised between 1 kPa and 100 kPa and not more than 5 GPa depending on the tissue to be regenerated or repaired.

As already stated, the nature of the biomaterial is an important parameter. Particularly good results have been obtained using bioactive carriers composed mostly with the main material component of the tissue to be regenerated and/or repaired. This generally allows for a better integration of the bioactive carrier, a better resorption from the surrounding cells already present and therefore a better regeneration or repair of the targeted tissue to be achieved.

In one example, said bioactive carrier for use in neuroregeneration-related applications has a stiffness comprised between about 0.01 kPa and about 3 kPa, preferably between about 0.01 kPa and about 1 kPa. In one example, said bioactive carrier for use in muscle, cartilage and T/L-related applications has a stiffness comprised between about 3 kPa and about 200 kPa, preferably between about 10 kPa and about 30 kPa. In one example, said bioactive carrier for use in bone-related applications has a stiffness comprised between about 30 kPa and about 3 GPa, preferably between about 70 kPa and about 200 kPa for instance in applications such as the treatment or prevention of osteoporosis and bone tissue regeneration. In one example, said bioactive carrier for use in hair-related applications has a stiffness comprised between about 0.01 kPa and about 200 kPa, preferably between about 3 kPa and about 70 kPa. In one example, said bioactive carrier for use in endothelization-related applications has a stiffness comprised between about 500 kPa and about 2.5 GPa. In one example, said bioactive carrier for use in angiogenesis-related applications has a stiffness comprised between about 0.01 kPa and about 100 kPa. In one example, said bioactive carrier for use in wound healing and skin-related applications has a stiffness comprised between about 0.01 kPa and about 70 kPa. For example, in certain embodiments, a pharmaceutical, dermatological or cosmetic association or combination of the present invention may be in the form of a dry, sterile powder.

In one particular example, the concentration or density (as defined herein) of a (modified) GFR-binding compound in, or on the surface of, a bioactive carrier as defined herein is comprised between 0.05 and 50 pmol/mm$^2$, in particular comprised between 0.1 and 30 pmol/mm$^2$, comprised between 0.1 and 10 pmol/mm$^2$, comprised between 0.1 and 5 pmol/mm$^2$, or comprised between 0.1 and 2 pmol/mm$^2$, each range being preferred and specifically contemplated to be combined with any other numerical or non-numerical ranges as described herein. Most particularly, the density is comprised between 0.2 and 2 pmol/mm$^2$.

VII. Medical Devices

For in-vivo administration, GFR-binding compounds, modified GFR-binding compounds or functionalised bioactive carriers of the present invention may be injected e.g. using an appropriate syringe, to a specific target site so that they may be delivered directly to the interior of e.g. a body articulation or under the skin in close proximity with the cells to be treated via, for instance, a PTD or cell-permeable peptide. Alternately, a medical device or implant (or implantable medical device) comprising such GFR-binding compounds, modified GFR-binding compounds or functionalised bioactive carriers may be used. Implants may contain reservoirs in which to place the GFR-binding compound, modified GFR-binding compound or functionalised bioactive carrier of the invention for release into the surrounding tissue, or may comprise a porous composition which may be soaked in a solution containing one or more GFR-binding compounds or modified GFR-binding compounds of the present disclosure prior to implantation.

Hydrogels, time-release capsules or spheres, liposomes, microspheres, nanospheres, biodegradable polymers, or other such drug delivery systems may also be employed to deliver GFR-binding compounds of the present invention to target cells and tissues. U.S. Pat. No. 6,475,516, for example, provides hydrogels being covalently bound to the surface of an in-dwelling medical device such as an implant, which may be used with GFR-binding compounds of the present disclosure.

In one aspect, the present disclosure provides a medical device comprising at least one GFR-compound, modified GFR-binding compound or functionalised bioactive carrier as defined herein. In one particular example, the medical device of the invention may be, partly or entirely, made of a functionalised bioactive carrier as defined herein or contain, for example, in certain embodiments, within a cavity thereof, said functionalised bioactive carrier.

In one example, said medical device may comprise between 1 wt % and 100 wt % of a functionalised bioactive carrier of the invention with respect to the total weight of the medical device. In one example, said medical device comprises between about 50 wt % and 100 wt %, between about 60 wt % and 100 wt %, between about 70 wt % and 100 wt %, between about 80 wt % and 100 wt %, between about 90 wt % and 100 wt % of a functionalised bioactive carrier of the invention with respect to the total weight of the medical device, all of which being specifically and individually preferred.

In an example, at least one part of a surface of said medical device comprises a GFR-binding compound, a modified GFR-binding compound or a functionalised bioactive carrier of the invention. For example, in certain embodiments, said medical device is preferably an implantable medical device.

Also suitable as medical devices for implementing embodiments of the present invention include stents, stiches, powders, granules, sponges, putties, injectable and non-injectable liquids, curable compositions, moldable compositions, membranes, glues, sprays, pills, filaments, prosthesis, or combinations thereof.

In one aspect, the present disclosure provides a bone graft material comprising a GFR-binding compound or a modified GFR-binding compound of the invention and a collagen as defined herein. In the present description and unless otherwise indicated, the term "bone graft material" means a material suitable for bone grafting.

VIII. Antibody:GFR-Binding Compound Complex

In one aspect, the present disclosure provides an antibody: GFR-binding compound complex comprising at least one (modified) GFR-binding compound and at least one antibody or any functional fragment thereof; wherein said (modified) GFR-binding compound is as defined herein.

Antibody: As used herein, unless indicated otherwise or contradictory in context, the terms "antibody" or "antibodies" refer to a light chain and heavy chain protein of an antibody that are encoded by a gene or genes that are either a naturally occurring gene or a codon-optimized gene. The antibody light chain and heavy chain genes may be human antibody light chain and heavy chain genes. Antibodies, or immunoglobulins, are proteins produced by cells of the immune system to identify and neutralize foreign substances, such as bacteria, viruses, or improperly proliferating native cells. Immunoglobulins are one class of desired globulin molecules and include, but are not limited to, IgG, IgM, IgA, IgD, IgE, IgY, lambda chains, kappa chains and fragments thereof; bi-specific antibodies, and fragments thereof; scFv fragments, Fc fragments, and Fab fragments as well as dimeric, trimeric and oligomeric forms of antibody fragments. Suitable antibodies include, but are not limited to, naturally occurring antibodies, animal-specific antibodies, human antibodies, humanized antibodies, autoantibodies and hybrid antibodies. Suitable antibodies also include antibodies with the ability to bind specific ligands. Suitable antibodies also include, but are not limited to, primary antibodies, secondary antibodies, designer antibodies, anti-protein antibodies, anti-peptide antibodies, anti-DNA antibodies, anti-RNA antibodies, anti-hormone antibodies, anti-hypophysiotropic peptides, antibodies against non-natural antigens, anti-anterior pituitary hormone antibodies, anti-posterior pituitary hormone antibodies, anti-venom antibodies, anti-tumor marker antibodies, antibodies directed against epitopes associated with infectious disease, including, anti-viral, anti-bacterial, anti-protozoal, anti-fungal, anti-parasitic, anti-receptor, anti-lipid, anti-phospholipid, anti-growth factor, anti-cytokine, anti-monokine, antiidiotype, and anti-accessory (presentation) protein antibodies. Suitable antibodies also include, but are not limited to, 3F8, 8H9, Abagovomab, Abciximab, Abituzumab, Abrilumab, Actoxumab, Adalimumab, Adecatumumab, Aducanumab, Afelimomab, Afutuzumab, Alacizumab pegol, ALD518, Alemtuzumab, Alirocumab, Altumomab pentetate, Amatuximab, Anatumomab mafenatox, Anetumab ravtansine, Anifrolumab, Anrukinzumab, Apolizumab, Arcitumomab, Ascrinvacumab, Aselizumab, Atezolizumab, Atinumab, Atlizumab, Atorolimumab, Bapineuzumab, Basiliximab, Bavituximab, Bectumomab, Begelomab, Belimumab, Benralizumab, Bertilimumab, Besilesomab, Bevacizumab, Bezlotoxumab, Biciromab, Bimagrumab, Bimekizumab, Bivatuzumab mertansine, Blinatumomab, Blosozumab, Bococizumab, Brentuximab vedotin, Briakinumab, Brodalumab, Brolucizumab, Brontictuzumab, Canakinumab, Cantuzumab mertansine, Cantuzumab ravtansine, Caplacizumab, Capromab pendetide, Carlumab, Catumaxomab, cBR96-doxorubicin immunoconjugate, CC49, Cedelizumab, Certolizumab pegol, Cetuximab, Ch.14.18, Citatuzumab bogatox, Cixutumumab, Clazakizumab, Cleneliximab, Clivatuzumab tetraxetan, Codrituzumab, Coltuximab ravtansine, Conatumumab, Concizumab, CR6261, Crenezumab, Dacetuzumab, Daclizumab, Dalotuzumab, Dapirolizumab pegol, Daratumumab, Dectrekumab, Demcizumab, Denintuzumab mafodotin, Denosumab, Derlotuximab biotin, Detumomab, Dinutuximab, Diridavumab, Dorlimomab aritox, Drozitumab, Duligotumab, Dupilumab, Durvalumab, Dusigitumab, Ecromeximab, Eculizumab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Epratuzumab, Erlizumab, Ertumaxomab, Etaracizumab, Etrolizumab, Evinacumab, Evolocumab, Exbivirumab, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gemtuzumab ozogamicin, Gevokizumab, Girentuximab, Glembatumumab vedotin, Golimumab, Gomiliximab, Guselkumab, Ibalizumab, Ibritumomab tiuxetan, Icrucumab, Idarucizumab, Igovomab, IMAB362, Imalumab, Imciromab, Imgatuzumab, Inclacumab, Indatuximab ravtansine, Indusatumab vedotin, Infliximab, Inolimomab, Inotuzumab ozogamicin, Intetumumab, Ipilimumab, Iratumumab, Isatuximab, Itolizumab, Ixekizumab, Keliximab, Labetuzumab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Mapatumumab, Margetuximab, Maslimomab, Matuzumab, Mavrilimumab, Mepolizumab, Metelimumab, Milatuzumab, Minretumomab, Mirvetuximab soravtansine, Mitumomab, Mogamulizumab, Morolimumab, Motavizumab, Moxetumomab pasudotox, Muromonab-CD3, Nacolomab tafenatox, Namilumab, Naptumomab estafenatox, Narnatumab, Natalizumab, Nebacumab, Necitumumab, Nemolizumab, Nerelimomab, Nesvacumab, Nimotuzumab, Nivolumab, Nofetumomab merpentan, Obiltoxaximab, Ocaratuzumab, Ocrelizumab, Odulimomab, Ofatumumab, Olaratumab, Olokizumab, Omalizumab, Onartuzumab, Ontuxizumab, Opicinumab, Oportuzumab monatox, Oregovomab, Orticumab, Otelixizumab, Otlertuzumab, Oxelumab, Ozanezumab, Ozoralizumab, Pagibaximab, Palivizumab, Panitumumab, Pankomab, Panobacumab, Parsatuzumab, Pascolizumab, Pasotuxizumab, Pateclizumab, Patritumab, Pembrolizumab, Pemtumomab, Perakizumab, Pertuzumab, Pexelizumab, Pidilizumab, Pinatuzumab vedotin, Pintumomab, Placulumab, Polatuzumab vedotin, Ponezumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Reslizumab, Rilotumumab, Rinucumab, Rituximab, Robatumumab, Roledumab, Romosozumab, Rontalizumab, Rovelizumab, Ruplizumab, Sacituzumab govitecan, Samalizumab, Sarilumab, Satumomab pendetide, Secukinumab, Seribantumab, Setoxaximab, Sevirumab, SGN-CD19A, SGN-CD33A, Sibrotuzumab, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teplizumab, Teprotumumab, Tesidolumab, TGN1412, Ticilimumab, Tigatuzumab, Tildrakizumab, TNX-650, Tocilizumab, Toralizumab, Tosatoxumab, Tositumomab, Tovetumab, Tralokinumab, Trastuzumab, TRBS07, Tregalizumab, Tremelimumab, Trevogrumab, Tucotuzumab celmoleukin, Tuvirumab, Ublituximab, Ulocuplumab, Urelumab, Urtoxazumab, Ustekinumab, Vandortuzumab vedotin, Vantictumab, Vanucizumab, Vapaliximab, Varlilumab, Vatelizumab, Vedolizumab, Veltuzumab, Vepalimomab, Vesencumab, Visilizumab, Volociximab, Vorsetuzumab mafodotin, Votumumab, Zalutumumab, Zanolimumab, Zatuximab, Ziralimumab, or Zolimomab aritox.

In certain embodiments, said antibody:GFR-binding compound complex is a covalent complex. In certain embodiments, said antibody:GFR-binding compound complex is a non-covalent complex.

IX. Dendrimer:GFR-Binding Compound Complex

In one aspect, the present disclosure provides a dendrimer:GFR-binding compound complex comprising at least one (modified) GFR-binding compound and at least one dendrimer or any functional fragment thereof; wherein said (modified) GFR-binding compound is as defined herein; and wherein said dendrimer is as already defined herein.

In certain embodiments, said dendrimer:GFR-binding compound complex is a covalent complex. In certain embodiments, said dendrimer:GFR-binding compound complex is a non-covalent complex.

X. Polynucleotides

The extracellular biological action of the GFR-binding peptides may also be conveyed via expression, by a cell, of the appropriate polynucleotide sequence engineered to encode a particular GFR-binding peptide of interest. One may thus inject or administer, to a mammal subject, a GFR-binding-peptide-encoding polynucleotide (such as a messenger RNA), wherein said polynucleotide would enable the intracellular production of the encoded GFR-binding peptide, which may, once released outside the host cell, exert its extracellular action on the host cell and/or on neighbouring cells and/or distant cells. In other words, GFR-binding peptides may be produced ex-vivo (e.g. using a peptide synthesizer) or in-vivo (e.g. via cell expression of a GFR-binding-peptide-encoding polynucleotide), and in all cases have an extracellular biological action of activation of growth factor receptors to induce cell differentiation and/or tissue regeneration.

Thus, in one aspect, the present disclosure provides a polynucleotide encoding at least one peptide as disclosed herein. In one particular example, said polynucleotide is a messenger RNA or a primary construct thereof. Said messenger RNA may additionally have a 5' cap structure chosen from the group consisting of m$^7$G(5')ppp (5')A,G(5')ppp (5')A and G(5')ppp(5')G. In one example, the messenger RNA additionally has a poly-A tail of from about 10 to 200 adenosine nucleotides. In one example, the messenger RNA additionally has a poly-C tail of from about 10 to 200 cytosine nucleotides. In one example, the messenger RNA additionally codes a tag for purification chosen from the group consisting of a hexahistidine tag (HIS tag, polyhistidine tag), a streptavidin tag (Strep tag), an SBP tag (streptavidin-binding tag) or a GST (glutathione S-transferase) tag, or codes for a tag for purification via an antibody epitope chosen from the group consisting of antibody-binding tags, a Myc tag, a Swal 1 epitope, a FLAG tag or an HA tag. In one example, the messenger RNA additionally codes a signal peptide and/or a localization sequence, in particular a secretion sequence. In one example, said polynucleotide is a complementary DNA of said messenger RNA or a primary construct thereof.

In one aspect, the present disclosure also provides a vector comprising a polynucleotide as defined in the present disclosure.

In one aspect, the present disclosure also provides a cultured cell comprising a vector as defined in the present disclosure.

In one aspect, the present disclosure also provides a method of expressing a peptide of interest, variant or analog thereof, in a mammalian cell, said method comprising: (i) providing an mRNA as defined in the present disclosure; and (ii) introducing said mRNA to a mammalian cell under conditions that permit the expression of the peptide of interest by the mammalian cell.

In one aspect, the present disclosure also provides a mRNA as disclosed herein for use in a medical treatment or prophylactic method. In one example, said medical treatment method is a therapeutic, surgical, or diagnostic method. In one particular example, said method is a method for treating or preventing cell-degeneration-associated diseases, disorders, conditions, or pathologies as defined in the present disclosure. In one particular example, said method is a method for regenerating mammalian tissues as disclosed herein.

In one aspect, the present disclosure also provides a use of a RNA or mRNA as defined in the present disclosure for the preparation of a pharmaceutical composition for the treatment or prevention of cell-degeneration-associated diseases, disorders, conditions, or pathologies as disclosed herein.

In one aspect, the present disclosure also provides a medical composition comprising a polynucleotide, a vector, or a transfected cell, all as defined in the present disclosure, and a medically acceptable excipient or carrier.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

mRNA: As used herein, the term "mRNA" refers to messenger RNA. Traditionally, the basic components of an mRNA molecule include at least a coding region, a 5'UTR, a 3'UTR, a 5'cap and a poly-A tail. Whereas the 5'UTR, 3'UTR, 5'cap and the poly-A tail are usually required to improve e.g. stability, translation and/or recognition by the ribosome, it is the coding region which comprises the sequence encoding the protein(s), polypeptide(s), or peptide(s) of (therapeutic) interest. Therefore, when the mRNA molecule as disclosed herein is conventionally described with reference to its coding region, any mRNA molecule also comprising at least one of a 5'UTR, a 3'UTR, a 5'cap or a poly-A tail forms an integral part of the present disclosure.

Coding region: As used herein, the term "coding region" or "coding sequence" refers to a portion of a polynucleotide that codes for a peptide or peptides of interest.

Primary RNA construct or transcript: As used herein, unless indicated otherwise or contradictory in context, the term "Primary RNA construct" or "Primary RNA transcript" refers to any precursor RNA molecule from a mature and functional (i.e. translatable) RNA molecule may be obtained. For instance, a precursor messenger RNA (pre-mRNA) is a type of primary transcript that becomes a messenger RNA (mRNA) after processing. Newly synthesized primary transcripts are modified in several ways to yield their mature form before they can be translated into a protein of interest. Such modifications include, but are not limited to, excision of introns, splicing of exons, addition of 5'cap and poly-A tail. Therefore, when reference is made to an RNA molecule, it shall be understood that it aims to cover all RNA molecules including, but not limited to, primary RNA transcripts or constructs at any stage of the modification process leading to a mature and functional RNA molecule e.g. with or without introns, exons, 5'cap, poly-A tail and/or any other conventional modifications, insofar as the RNA molecule contains a coding region or a precursor thereof allowing for a peptide of interest encoded by said coding region or precursor thereof to be expressed.

5' Capping: As used herein, unless indicated otherwise or contradictory in context, the term "5' Capping" ou "5' Cap" refers to a 5' cap structure of an mRNA that is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns removal during mRNA splicing. Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue.

Poly-A tails: During RNA processing, a long chain of adenine nucleotides (poly-A tail) may be added to a polynucleotide such as an mRNA molecules in order to increase stability. Immediately after transcription, the 3' end of the transcript may be cleaved to free a 3' hydroxyl. Then poly-A polymerase adds a chain of adenine nucleotides to the RNA. The process, called polyadenylation, adds a poly-A tail that can be between, for example, approximately 100 and 250 residues long.

Untranslated regions: As used herein, the term "Untranslated regions" or UTRs of a gene refers to regions that are transcribed but not translated. The 5'UTR starts at the transcription start site and continues to the start codon but does not include the start codon; whereas, the 3'UTR starts immediately following the stop codon and continues until the transcriptional termination signal. The regulatory features of a UTR can be incorporated into the polynucleotides, primary constructs and/or mRNA of the present disclosure to enhance the stability of the molecule.

3'UTR: As used herein, unless indicated otherwise or contradictory in context, the term "3'UTR" or "three prime untranslated region" refers to the section of messenger RNA that immediately follows the translation termination codon. The 3'-UTR often contains regulatory regions that post-transcriptionally influence gene expression.

5'UTR: As used herein, unless indicated otherwise or contradictory in context, the term "5'UTR" or "five prime untranslated region" refers to the section of mRNA that starts at the transcription start site and continues to the start codon but does not include the start codon. There is growing body of evidence about the regulatory roles played by the UTRs in terms of stability of the nucleic acid molecule and translation. Natural 5'UTRs bear features which play roles in for translation initiation. 5' UTR also have been known to form secondary structures which are involved in elongation factor binding.

Complementary DNA: As used herein, the term "complementary DNA" or "cDNA" refers to a DNA molecule containing an eukaryote gene which has been tailored or engineered to be expressed in a prokaryote host cell. cDNA is also called "intron-free" DNA as it lacks the gene regions encoding introns, its transcription yielding an intron-free mRNA molecule.

In one aspect, the present disclosure provides a vector comprising a polynucleotide encoding at least one peptide, variant or analog thereof, having growth factor receptor-binding capability or capabilities, as defined herein.

Vector: As used herein, unless indicated otherwise or contradictory in context, the term "vector" is used in its most general meaning and refers to any intermediary vehicle for a nucleic acid which enables said nucleic acid, for example, to be introduced into prokaryotic and/or eukaryotic cells and, where appropriate, to be integrated into a genome. Vectors of this kind are preferably replicated and/or expressed in the cells. Vectors may comprise plasmids, phagemids, bacteriophages or viral genomes.

Plasmid: As used herein, unless indicated otherwise or contradictory in context, the term "plasmid" refers to a double-stranded (which may be circular) DNA sequence that is capable of automatically replicating in a host cell.

In one aspect, the present disclosure provides a cultured cell (or transfected cell) comprising a polynucleotide encoding at least one peptide, variant or analog thereof, having growth factor receptor-binding capability or capabilities, as defined herein.

In one aspect, the present disclosure provides a medical composition comprising at least one of a polynucleotide encoding at least one peptide, variant or analog thereof, having growth factor receptor-binding capability or capabilities, as defined herein, a vector comprising such a polynucleotide, or a transfected cell comprising such a vector, and a medically acceptable carrier.

In one aspect, the present disclosure provides methods and uses for inducing cell differentiation, regenerating tissues and protecting a patient from cell-degeneration-related diseases, conditions, disorders or pathologies, using at least one of a polynucleotide encoding at least one peptide, variant or analog thereof, having growth factor receptor-binding capability or capabilities, as defined herein, a vector comprising such a polynucleotide, a transfected cell comprising such a vector, or a medical composition comprising them.

XI. Pharmaceutical Compositions

The present disclosure provides GFR-binding compounds, modified GFR-binding compounds and functionalised bioactive carrier, which may be used for inducing stem cell differentiation and tissue regeneration.

In one aspect, the present disclosure provides a composition such as a pharmaceutical, prophylactic, surgical, diagnostic, or imaging composition (hereinafter shorten as pharmaceutical or medical composition) comprising at least one (modified) GFR-binding compound or a functionalised bioactive carrier as defined herein and further comprising at least one pharmaceutically acceptable excipient carriers and/or vehicles.

Formulations of the pharmaceutical compositions described herein may be prepared by any method known or hereafter developed in the art of pharmacology. Generally, such methods of preparation include the step of bringing the active ingredient(s) into association with an excipient and/or one or more other accessory ingredients, and then, if necessary and/or desirable, shaping and/or packaging the product into a desired single- or multi-dose unit.

For example, in certain embodiments, a pharmaceutical composition as defined herein may contain between 0.01% and 100% by weight (over the total weight of the pharmaceutical composition) of a (modified) GFR-binding compound or a functionalised bioactive carrier, both as defined herein, as a pharmaceutically effective amount. The pharmaceutical composition particularly comprises between 0.01% and 95%, between 0.01% and 90%, between 0.01% and 85%, between 0.01% and 80%, between 0.01% and 75%, between 0.01% and 70%, between 0.01% and 65%, between 0.01% and 60%, between 0.01% and 55%, between 0.01% and 50%, between 0.01% and 45%, between 0.01% and 40%, between 0.01% and 35%, between 0.01% and 30%, between 0.01% and 25%, between 0.01% and 20%, between 0.01% and 15%, between 0.01% and 10%, between 0.01% and 5%, between 0.1% and 100%, between 0.1% and 95%, between 0.1% and 90%, between 0.1% and 85%, between 0.1% and 80%, between 0.1% and 75%, between 0.1% and 70%, between 0.1% and 65%, between 0.1% and 60%, between 0.1% and 55%, between 0.1% and 50%, between 0.1% and 45%, between 0.1% and 40%, between 0.1% and 35%, between 0.1% and 30%, between 0.1% and 25%, between 0.1% and 20%, between 0.1% and 15%, between 0.1% and 10%, and between 0.1% and 5% by weight (over the total weight of the pharmaceutical composition) of any one of a (modified) GFR-binding compound or a functionalised bioactive carrier as defined herein.

Generally, the (modified) GFR-binding compounds or functionalised bioactive carriers as defined herein may thus be administered as such or as part of a formulation in association with one or more pharmaceutically acceptable excipients, carriers and/or vehicles so as to form what is generally referred to as a pharmaceutical composition or pharmaceutical formulation.

Pharmaceutical effective amount: As used herein, unless indicated otherwise or contradictory in context, the term "pharmaceutical effective amount" or "therapeutically effective amount" refers to an amount of an agent to be delivered (e.g., nucleic acid, protein, peptide, drug, therapeutic agent, diagnostic agent, prophylactic agent, etc.) that is sufficient, when administered to a subject suffering from or susceptible to an infection, disease, disorder, condition and/or pathology, to produce/provide a therapeutically effective outcome. Thus, a "pharmaceutical effective amount" depends upon the context in which it is being applied. A pharmaceutical effective amount of a composition is provided based, at least in part, on the target tissue, target cell type, means of administration, physical characteristics of the pharmaceutical association or composition (e.g., size, 3D shape, etc.), and other determinants. For example, in certain embodiments, in the context of providing an agent that induces tissue regeneration, a pharmaceutical effective amount of an agent is, for example, in certain embodiments, an amount sufficient to achieve tissue regeneration, as compared to the response obtained without provision of the agent. For example, in certain embodiments, a therapeutically effective amount as used herein is any of the herein disclosed weight or molar amounts, ratios or ranges of the (modified) GFR-binding compound or functionalised bioactive carrier.

Therapeutically effective outcome: As used herein, unless indicated otherwise or contradictory in context, the term "therapeutically effective outcome" refers to an outcome that is sufficient in a subject suffering from or susceptible to an infection, disease, disorder, condition and/or pathology, to treat, improve symptoms of, diagnose, prevent, and/or delay the onset of the infection, disease, disorder, condition and/or pathology.

Therapeutic Agent: As used herein, unless indicated otherwise or contradictory in context, the term "therapeutic agent" refers to any agent that, when administered to a subject/patient/individual, has a therapeutic, diagnostic, and/or prophylactic effect and/or elicits a desired biological and/or pharmacological effect.

Pharmaceutically acceptable: As used herein, unless indicated otherwise or contradictory in context, the term "pharmaceutically acceptable" refers to those compounds, materials, compositions, and/or dosage forms which are, within the ambit of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: As used herein, unless indicated otherwise or contradictory in context, the term "pharmaceutically acceptable excipient" refers to any ingredient other than the compounds described herein (i.e. GFR-binding compounds, bioactive carriers as defined herein or any further active principles) and satisfying to the herein defined definition of pharmaceutically acceptable for a patient. Excipients may include, for example: inert diluents, dispersing and/or granulating agents, surface active agents and/or emulsifiers, disintegrating agents, binding agents, preservatives, buffering agents, lubricating agents, oils, printing inks, sweeteners, and/or waters of hydration. The choice of excipient(s) will largely depend on factors such as the particular mode of administration, the effect of the excipient(s) on solubility and stability, and the nature of the dosage form. In one embodiment, the pharmaceutically acceptable excipient is not a naturally occurring excipient.

Diluents: As used herein, unless indicated otherwise or contradictory in context, diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, powdered sugar and/or any combinations thereof.

Buffering agents: As used herein, unless indicated otherwise or contradictory in context, buffering agents include, but are not limited to, citrate buffer solutions, acetate buffer solutions, phosphate buffer solutions, ammonium chloride, potassium acetate, potassium chloride, monobasic potassium phosphate, calcium carbonate, calcium chloride, calcium citrate, calcium gluconate, calcium lactate, propanoic acid, calcium levulinate, pentanoic acid, phosphoric acid, calcium hydroxide phosphate, sodium acetate, sodium bicarbonate, sodium chloride, sodium citrate, sodium lactate, magnesium hydroxide, aluminum hydroxide, alginic acid, pyrogen-free water, isotonic saline, Ringer's solution, ethyl alcohol and any combinations thereof.

Granulating and/or dispersing agents: As used herein, unless indicated otherwise or contradictory in context, granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone), sodium carboxymethyl starch, carboxymethyl cellulose, cross-linked sodium carboxymethyl cellulose, methylcellulose, pregelatinized starch, microcrystalline starch, water insoluble starch, calcium carboxymethyl cellulose, magnesium aluminum silicate, sodium lauryl sulfate, quaternary ammonium compounds and/or any combinations thereof.

Surface active agents and/or emulsifiers: As used herein, unless indicated otherwise or contradictory in context, surface active agents and/or emulsifiers include, but are not limited to, colloidal clays (such as aluminum silicates and magnesium aluminum silicates), natural emulsifiers (such as acacia, agar, sodium alginate, cholesterol, xanthan, pectin, gelatin, egg yolk, casein, cholesterol, wax, and lecithin), long chain amino acid derivatives, high molecular weight alcohols (such as stearyl, cetyl and oleyl alcohols, triacetin monostearate, ethylene glycol distearate and glyceryl monostearate), carbomers (such as carboxy polymethylene, polyacrylic acid, acrylic acid polymer, and carboxyvinyl polymer), diethylene glycol monolaurate, triethanolamine oleate, sodium oleate, potassium oleate, ethyl oleate, oleic acid, ethyl laurate, sodium lauryl sulfate, cetrimonium bromide, cetylpyridinium chloride, benzalkonium chloride, docusate sodium, carrageenan, cellulosic derivatives (such as carboxymethylcellulose sodium, hydroxymethyl cellulose, hydroxypropyl methylcellulose and methylcellulose), sorbitan fatty acid esters (such as polyoxyethylene sorbitan monolaurate, polyoxyethylene sorbitan, polyoxyethylene sorbitan monooleate, sorbitan monopalmitate and glyceryl monooleate), polyoxyethylene esters, sucrose fatty acid esters, polyethylene glycol fatty acid esters, polyoxyethylene ethers, poly(vinyl-pyrrolidone), and any combinations thereof.

Binding agents: As used herein, unless indicated otherwise or contradictory in context, binding agents include, but are not limited to, natural and synthetic gums (such as acacia, sodium alginate, carboxymethylcellulose, methylcellulose, ethylcellulose, hydroxyethylcellulose, hydroxypropyl cellulose, hydroxypropyl methylcellulose, microcrystalline cellulose, cellulose acetate and poly(vinyl-pyrrolidone), gelatin, starch, sugars (such as sucrose, dextrose, glucose, dextrin, lactose, and mannitol), alignates, magnesium aluminum silicates, polyethylene glycol, polyethylene oxide, inorganic calcium salts, water, alcohol, silicic acid, waxes, and any combinations thereof.

Preservatives: As used herein, unless indicated otherwise or contradictory in context, preservatives include, but are not limited to, antioxidants, chelating agents, antifungal preservatives, antimicrobial preservatives, acidic preservatives, and alcohol preservatives.

Antioxidants: As used herein, unless indicated otherwise or contradictory in context, antioxidants include, but are not limited to, alpha tocopherol, ascorbic acid, acorbyl palmitate, butylated hydroxyanisole, propionic acid, potassium metabisulfite, propyl gallate, sodium metabisulfite, sodium ascorbate, and sodium sulfite.

Chelating agents: As used herein, unless indicated otherwise or contradictory in context, chelating agents include ethylenediaminetetraacetic acid (EDTA), fumaric acid, malic acid, phosphoric acid, citric acid monohydrate and tartaric acid.

Antimicrobial preservatives: As used herein, unless indicated otherwise or contradictory in context, antimicrobial preservatives include, but are not limited to, benzalkonium chloride, benzethonium chloride, chlorhexidine, chlorobutanol, chlorocresol, chloroxylenol, benzyl alcohol, bronopol, cetylpyridinium chloride, cresol, ethyl alcohol, glycerin, hexetidine, imidurea, phenoxyethanol, phenylmercuric nitrate, phenylethyl alcohol, phenol, and propylene glycol.

Antifungal preservatives: As used herein, unless indicated otherwise or contradictory in context, antifungal preservatives include, but are not limited to, benzoic acid, hydroxybenzoic acid, butyl paraben, methyl paraben, ethyl paraben, propyl paraben, potassium benzoate, sodium propionate, potassium sorbate, and/or sorbic acid.

Alcohol preservatives: As used herein, unless indicated otherwise or contradictory in context, alcohol preservatives include, but are not limited to, phenol, phenolic compounds, bisphenol, ethanol, polyethylene glycol, chlorobutanol and hydroxybenzoate.

Acidic preservatives: As used herein, unless indicated otherwise or contradictory in context, acidic preservatives include, but are not limited to, vitamin A, vitamin C, vitamin E, beta-carotene, acetic acid, citric acid, dehydroacetic acid, and sorbic acid.

Lubricating agents: As used herein, unless indicated otherwise or contradictory in context, lubricating agents include, but are not limited to, magnesium stearate, calcium stearate, stearic acid, sodium benzoate, sodium acetate, sodium chloride, silica, talc, malt, glyceryl behanate, hydrogenated vegetable oils, polyethylene glycol, magnesium lauryl sulphate and any combinations thereof.

Sweeteners: As used herein, unless indicated otherwise or contradictory in context, sweeteners include, but are not limited to, any natural or synthetic sugar substitutes. Natural sugar substitutes include, but are not limited to, brazzein, curculin, erythritol, glycyrrhizin, glycerol, hydrogenated starch hydrolysates, inulin, isomalt, lactitol, mogroside mix, mabinlin, maltitol, malto-oligosaccharide, mannitol, miraculin, monatin, monellin, osladin, pentadin, sorbitol, stevia, tagatose, thaumatin, and xylitol. Synthetic sugar substitutes include, but are not limited to, acesulfame potassium, advantame, alitame, aspartame, salt of aspartame-acesulfame, sodium cyclamate, dulcin, glucin, neohesperidin dihydrochalcone, neotame, P-4000, saccharin, Sucralose.

Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch, stearic acid, sucrose, talc, titanium dioxide, vitamin A, vitamin E, vitamin C, and xylitol. Suitable excipients for use in the present invention also include, but are not limited to, water, phosphate buffered saline (PBS), Ringer's solution, dextrose solution, serum-containing solutions, Hank's solution, other aqueous physiologically balanced solutions, oils, esters and glycols. Aqueous excipients can contain suitable auxiliary substances required to approximate the physiological conditions of the recipient, for example, in certain embodiments, by enhancing chemical stability and isotonicity.

Pharmaceutically acceptable carriers: As used herein, unless indicated otherwise or contradictory in context, the term "pharmaceutically acceptable carriers" or "carriers" refers to pharmaceutically acceptable excipients and/or delivery vehicles suitable for delivering a pharmaceutical or therapeutic composition useful in a therapeutic method and uses of the present invention to a suitable in-vivo or ex-vivo site. Preferred pharmaceutically acceptable carriers are capable of maintaining a composition containing an active combination or association of a (modified) GFR-binding compound and a bioactive carrier as defined herein, in a form that, upon arrival of the combination to a target cell, site or tissue, the active combination is capable of performing one or more biological functions thereof the protein at the cell or tissue site. One type of pharmaceutically acceptable carrier includes a controlled release formulation that is capable of slowly releasing a composition or combination into an animal. In one example, a controlled release formulation comprises an active combination or association as defined herein in a controlled release vehicle. Suitable controlled release vehicles include, but are not limited to, microparticles, biocompatible polymers, other polymeric matrices, capsules, microcapsules, osmotic pumps, bolus preparations, diffusion devices, liposomes, liposheres, and transdermal delivery systems. Such suitable controlled release vehicle may be combined with at least one targeting moiety. In one embodiment, the pharmaceutically acceptable carrier is not a naturally occurring carrier.

Targeting Moieties: In one example, the functionalised bioactive carrier disclosed herein includes at least one binding partner which functions to target the cell to a specific tissue space or to interact with a specific moiety, either in-vivo, ex-vivo or in-vitro. Suitable binding partners include antibodies and functional fragments thereof, scaffold proteins, or peptides.

In one example, said excipients, carriers or vehicles are compatible with the (modified) GFR-binding compounds or functionalised bioactive carriers defined herein so that they do not disrupt, tamper, modify, de-organise, de-combine or de-associate said the (modified) GFR-binding compounds or functionalised bioactive carriers. In contrast, said excipients, carriers or vehicles preserves, maintains or reinforces the stability of the (modified) GFR-binding compounds or functionalised bioactive carriers so as to preserve their biological activity.

In one example, the present pharmaceutical compositions also include pharmaceutically acceptable salts and/or solvates and/or prodrugs and/or isotopically-labelled derivatives of the substances and compounds described herein such as the (modified) GFR-binding compounds or any other active principles.

Pharmaceutically acceptable salts: As used herein, unless indicated otherwise or contradictory in context, the term "pharmaceutically acceptable salts" refers to derivatives of the disclosed substances and compounds wherein the parent substance or compound is modified by converting an existing acid or base moiety to its salt form (e.g., by reacting the free base group with a suitable organic acid). The degree of ionization in the salt may vary from completely ionized to almost non-ionized. Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxyethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, in certain embodiments, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, non-aqueous media like ether, ethyl acetate, ethanol, isopropanol, or acetonitrile are preferred. Lists of suitable salts are generally found in Remington's Pharmaceutical Sciences, 17th ed., Mack Publishing Company, Easton, Pa., 1985, p. 1418 and in Pharmaceutical Salts: Properties, Selection, and Use, P. H. Stahl and C. G. Wermuth (eds.), Wiley-VCH, 2008, each of which being incorporated herein by reference in its entirety. In one embodiment, the pharmaceutically acceptable salt is not a naturally occurring salt.

Pharmaceutically acceptable solvate: As used herein, unless indicated otherwise or contradictory in context, the term "pharmaceutically acceptable solvate," refers to a compound, substance, association or combination wherein molecules of a suitable solvent are incorporated in the crystal lattice. A suitable solvent is physiologically tolerable at the dosage administered. For example, in certain embodiments, solvates may be prepared by crystallization, recrystallization, or precipitation from a solution that includes organic solvents, water, or a mixture thereof. Examples of suitable solvents are ethanol, water (For example, in certain embodiments, mono-, di-, and tri-hydrates), N-methylpyrrolidinone (NMP), dimethyl sulfoxide (DMSO), dimethylformamide (DMF), [Nu],[Nu]'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate". In one embodiment, the pharmaceutically acceptable solvate is not a naturally occurring solvate.

Pharmaceutically acceptable isotopically-labelled compounds: In one example, the present invention also includes all pharmaceutically acceptable isotopically-labelled derivatives, which are identical to the compounds, substances, combinations or associations described herein but wherein one or more atoms are replaced by atoms having an atomic mass or mass number different from the atomic mass or mass number usually found in nature. Examples of isotopes that may be incorporated into GFR-binding compound(s) as defined herein include isotopes of hydrogen, carbon, chlorine, fluorine, iodine, nitrogen, oxygen, and sulfur, such as $^2$H, $^3$H, $^{11}$C, $^{13}$C, $^{14}$C, $^{36}$Cl, $^{18}$F, $^{123}$I, $^{13}$N, $^{15}$N, $^{17}$O, $^{18}$O, and $^{35}$S, respectively. It should be understood that compounds, substances, combinations, associations, prodrugs, and pharmaceutical acceptable salts thereof described herein which contain the aforementioned isotopes and/or other isotopes of other atoms are within the scope of the invention. Certain isotopically labeled of the compounds, substances, combinations, associations, prodrugs, and salts thereof such as, for example, in certain embodiments, those incorporating a radioactive isotope such as $^3$H and $^{14}$C, are useful in drug and/or substrate tissue distribution studies. Tritium, i.e. $^3$H, and carbon-14, i.e. $^{14}$C, are particularly preferred due to their ease of preparation and detection. Further, substitution with heavier isotopes such as deuterium, i.e. $^2$H, can afford certain therapeutic advantages resulting from greater metabolic stability, for example, in certain embodiments, increased in vivo half-life or reduced dosage requirements, and hence may be preferred in some circumstances. Isotopically labeled compounds, substances, combinations, associations, prodrugs, and salts thereof can generally be prepared by carrying out the procedures disclosed in the Schemes and/or in the Examples by substituting a readily available non-isotopically labeled reagent for an isotopically labeled reagent.

Prodrugs: As used herein, unless indicated otherwise or contradictory in context, the term "prodrug" refers to a compound, substance, combination or association that is transformed in vivo to yield a compound, substance, combination or association as defined herein or a pharmaceutically acceptable salt or solvate thereof. The transformation may occur by various mechanisms, such as via hydrolysis in blood. A prodrug of a compound, substance, combination or association defined herein may be formed in a conventional manner with one or more functional groups in the compound, such as an amino, hydroxyl or carboxyl group. For example, in certain embodiments, if a compound defined herein contains a carboxylic acid functional group, a prodrug can comprise: (1) an ester formed by the replacement of a hydrogen of the acid group with a group such as (C1-C6)alkyl or (C6-C10) aryl; (2) an activated ester formed by the replacement of the hydrogen of the acid group with groups such as —(CR$^2$)COOR', where CR$^2$ is a spacer and R can be groups such as H or methyl and R' can be groups such as (C1-C6)alkyl or (C6-C10) aryl; and/or (3) a carbonate formed by the replacement of the hydrogen of the acid with groups such as CHROCOOR' where R can be groups such as H or methyl and R' can be groups such as (C1-C6)alkyl or (C6-C10)aryl. Similarly, if a compound defined herein contains an alcohol functional group, a prodrug can be formed via the replacement of the hydrogen of the alcohol with groups such as (C1-C6)alkanoyloxymethyl or (C1-C6) alkanoyloxyaryl or by forming an ester via condensation with, for example, in certain embodiments, an amino acid.

Where a compound defined herein contains a primary or secondary amino group, a prodrug may comprise, for example, in certain embodiments, an amide formed by the replacement of one or both of the hydrogen atoms of the amino group with (C1-C10)alkanoyl or (C6-C10)aroyl. Other prodrugs of amines are well known to those skilled in the art. Alternatively, certain compounds defined herein may themselves act as prodrugs of other compounds defined herein. Discussions regarding prodrugs and their use can be found in, for example, in certain embodiments, "Prodrugs as Novel Delivery Systems," T. Higuchi and W. Stella, Vol. 14 of the ACS Symposium Series, and Bioreversible Carriers in Drug Design, Pergamon Press, 1987 (ed. E B Roche, American Pharmaceutical Association). Examples of other prodrug types may be found in the aforementioned reference which is hereby incorporated by reference.

XII. Administration Routes and Procedures (Modified) GFR-binding compounds, substances, functionalised bioactive carrier to be delivered and/or pharmaceutical, dermatological, prophylactic, diagnostic, or imaging compositions or formulations thereof in accordance with the present disclosure may be administered by any route of administration effective for preventing, treating, diagnosing, or imaging a disease, disorder, or condition and/or treating or alleviating at least one symptoms thereof and/or inducing tissue formation/regeneration and/or reducing or preventing tissue degeneration.

Suitable administration protocols include any in-vitro, in-vivo or ex-vivo administration protocol. The preferred types and routes of administration will be apparent to those of skill in the art, depending on the type of condition or disease to be prevented or treated or the nature of tissue to regenerate; whether the composition is nucleic acid based, protein based, cell based or combinations or mixtures thereof; and/or the target cell/tissue.

Ex-vivo and in-vitro administration: As used herein, unless indicated otherwise or contradictory in context, the term "ex-vivo administration" refers to performing the regulatory step outside of the subject/patient, such as administering a (modified) GFR-binding compounds, functionalised bioactive carrier or medical compositions as defined herein to a population of cells (e.g., mesenchymal stem cells) removed from a subject/patient for e.g. diagnostic, analysis and/or academic purposes.

Cells, tissues or organs can be contacted ex vivo or in vitro with a (modified) GFR-binding compound or a functionalised bioactive carrier by any suitable method, including mixing or the use of a delivery vehicle. Effective in vitro or ex vivo culture conditions include, but are not limited to, effective media, bioreactor, temperature, pH and oxygen conditions that permit cell culture. An effective medium refers to any medium in which a given host cell or tissue is typically cultured. Such medium typically comprises an aqueous medium having assimilable carbon, nitrogen and phosphate sources, and appropriate salts, minerals, metals and other nutrients, such as vitamins. Cells can be cultured in conventional fermentation bioreactors, shake flasks, test tubes, microtiter dishes, and petri plates. Culturing can be carried out at a temperature, pH and oxygen content appropriate for a cell or tissue. Such culturing conditions are within the expertise of one of ordinary skill in the art.

In one aspect, the present disclosure thus also provides a method for inducing tissue formation, in-vitro or ex-vivo, said method comprising the administration to a cell (e.g. a non-fully differentiated cell) of an effective amount of a GFR-binding compound, a functionalised bioactive carrier or a composition thereof as defined herein.

In-vivo administration: In one example, (modified) GFR-binding compounds, functionalised bioactive carriers or pharmaceutical, prophylactic, diagnostic, or imaging compositions are administered by one or more of a variety of routes, including oral, intravenous, intramuscular, intra-arterial, intramedullary, rectal, intravaginal, intrathecal, subcutaneous, intraventricular, transdermal, intradermal, intraperitoneal, topical (e.g. by ointments, creams, powders, lotions, gels, and/or drops), buccal, enteral, mucosal, nasal, vitreal, sublingual, by intra-tracheal instillation, bronchial instillation, and/or inhalation, as an oral spray, nasal spray, and/or aerosol, and/or through a portal vein catheter. In one example, (modified) GFR-binding compounds, functionalised bioactive carrier or pharmaceutical, prophylactic, diagnostic, or imaging compositions are administered by systemic intravenous injection. In one example, (modified) GFR-binding compounds, functionalised bioactive carrier or pharmaceutical, prophylactic, diagnostic, or imaging compositions may be administered in a way which allows them to cross the blood-brain barrier, vascular barrier, or other epithelial barrier.

Delivery: As used herein, unless indicated otherwise or contradictory in context, the term "delivery" refers to the act or manner of delivering a compound, substance, composition, entity, moiety, cargo or payload.

Delivery Agent: As used herein, unless indicated otherwise or contradictory in context, the term "delivery agent" refers to any substance which facilitates, at least in part, the in vivo delivery of a (modified) GFR-binding compounds, functionalised bioactive carriers or pharmaceutical, prophylactic, diagnostic, or imaging compositions defined herein to targeted cells.

Forms suitable for oral administration: A (modified) GFR-binding compound, functionalised bioactive carrier or pharmaceutical, prophylactic, diagnostic, or imaging compositions of the invention, for example, in certain embodiments, includes forms suitable for oral administration as a tablet, capsule, pill, powder, sustained release formulations, solution, suspension, or for parenteral injection as a sterile solution, suspension or emulsion. Pharmaceutical compositions suitable for the delivery of (modified) GFR-binding compounds, functionalised bioactive carrier or pharmaceutical, prophylactic, diagnostic, or imaging compositions defined herein and methods for their preparation will be readily apparent to those skilled in the art. Such compositions and methods for their preparation may be found, for example, in certain embodiments, in 'Remington's Pharmaceutical Sciences', 19th Edition (Mack Publishing Company, 1995), which is hereby incorporated by reference in its entirety. Oral administration may involve swallowing, so that the compounds or associations enters the gastrointestinal tract, or buccal or sublingual administration may be employed by which the compound enters the blood stream directly from the mouth. Formulations suitable for oral administration include solid formulations, such as tablets, capsules containing particulates, liquids, or powders; lozenges (including liquid-filled), chews; multi- and nano-particulates; gels, solid solution, liposome, films (including muco-adhesive), ovules, sprays and liquid formulations. Liquid formulations include suspensions, solutions, syrups and elixirs. Such formulations may be employed as fillers in soft or hard capsules and typically comprise a carrier, for example, in certain embodiments, water, ethanol, polyethylene glycol, propylene glycol, methylcellulose, or a suitable oil, and one or more emulsifying agents and/or suspending agents. Liquid formulations may also be prepared by the reconstitution of a solid, for example, in certain embodiments, from a sachet. The pharmaceutical associations or compositions defined herein may also be used in fast-dissolving, fast-disintegrating dosage forms such as those described in the art.

Forms suitable for parenteral administration: In one example, (modified) GFR-binding compounds, functionalised bioactive carriers or pharmaceutical, prophylactic, diagnostic, or imaging compositions of the invention may be administered by parenteral injection. Exemplary parenteral administration forms include sterile solutions, suspensions or emulsions of the pharmaceutical association defined herein in sterile aqueous media, for example, in certain embodiments, aqueous propylene glycol or dextrose. In another embodiment, the parenteral administration form is a solution. Such parenteral dosage forms can be suitably buffered, if desired. Preferred sterile solutions include sodium chloride, 0.9%, UPS solution. Injectable formulations can be sterilized, for example, in certain embodiments, by filtration through a bacterial-retaining filter, and/or by incorporating sterilizing agents in the form of sterile solid compositions which can be dissolved or dispersed in sterile water or other sterile injectable medium prior to use.

Forms suitable for rectal and vaginal administration: Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Forms suitable for topical and/or transdermal administration: Dosage forms for topical and/or transdermal administration of a composition may include ointments, pastes, creams, lotions, gels, powders, solutions, sprays, inhalants and/or patches. Generally, an active ingredient is admixed under sterile conditions with a pharmaceutically acceptable excipient and/or any needed preservatives and/or buffers as may be required.

Forms suitable for pulmonary administration: Dosage forms for pulmonary administration via the buccal cavity may comprise dry particles which comprise the active ingredient (e.g. the pharmaceutical association defined herein) and which have a diameter in the range from about 0.5 nm to about 7 nm. Such compositions are conveniently in the form of dry powders for administration using a device comprising a dry powder reservoir to which a stream of propellant may be directed to disperse the powder and/or using a self-propelling solvent/powder dispensing container such as a device comprising the active ingredient dissolved and/or suspended in a low-boiling propellant in a sealed container. Pharmaceutical compositions formulated for pulmonary delivery may provide an active ingredient in the form of droplets of a solution and/or suspension. Such formulations may be prepared, packaged, and/or sold as aqueous and/or dilute alcoholic solutions and/or suspensions, optionally sterile, comprising active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate.

Forms suitable for nasal administration: Formulations described herein as being useful for pulmonary delivery are also useful for intranasal delivery of a pharmaceutical composition. Formulations suitable for nasal administration may, for example, in certain embodiments, comprise from about as little as 0.1% (w/w) and as much as 100% (w/w) of active ingredient (e.g. the pharmaceutical association defined herein), and may comprise one or more of the additional ingredients described herein. A pharmaceutical composition may be prepared, packaged, and/or sold in a formulation suitable for buccal administration. Such formulations may, for example, in certain embodiments, be in the form of tablets and/or lozenges made using conventional methods, and may, for example, in certain embodiments, 0.1% to 20% (w/w) active ingredient, the balance comprising an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

Forms suitable for ophthalmic administration: Dosage forms for ophthalmic administration include, for example, in certain embodiments, eye drops including, for example, in certain embodiments, a 0.1/1.0% (w/w) solution and/or suspension of the active ingredient (e.g. the pharmaceutical association defined herein) in an aqueous or oily liquid excipient. Such drops may further comprise buffering agents, salts, and/or one or more other of any additional ingredients described herein. Other ophthalmically-administrable formulations which are useful include those which comprise the active ingredient in microcrystalline form and/or in a liposomal preparation. Ear drops and/or eye drops are contemplated as being within the scope of this present disclosure.

Direct injection: One preferred administration method for delivering (modified) GFR-binding compounds, functionalised bioactive carriers or pharmaceutical, prophylactic, diagnostic, or imaging compositions as defined herein is by local administration, in particular, by direct injection. Direct injection techniques are particularly useful for administering a composition to a cell or tissue that is accessible by surgery, and particularly, on or near the surface of the body. Administration of a composition locally within the area of a target cell refers to injecting the composition centimeters and preferably, millimeters from the target cell or tissue.

Dosage regimens: The dosage regimen of the (modified) GFR-binding compounds, functionalised bioactive carriers or pharmaceutical, prophylactic, diagnostic, or imaging compositions as defined herein may be adjusted to provide the optimum desired response. For example, in certain embodiments, a single bolus may be administered, several divided doses may be administered over time or the dose may be proportionally reduced or increased as indicated by the exigencies of the therapeutic situation. The appropriate dosing regimen, the amount of each dose administered and/or the intervals between doses will depend upon the pharmaceutical association being used, the type of pharmaceutical composition, the characteristics of the subject in need of treatment and the severity of the condition being treated. Thus, the skilled artisan would appreciate, based upon the disclosure provided herein, that the dose and dosing regimen is adjusted in accordance with methods well-known in the therapeutic arts. That is, the maximum tolerable dose can be readily established, and the effective amount providing a detectable therapeutic benefit to a patient may also be determined, as can the temporal requirements for administering each agent to provide a detectable therapeutic benefit to the patient. Accordingly, while certain dose and administration regimens are exemplified herein, these examples in no way limit the dose and administration regimen that may be provided to a patient in practicing the present invention. In general, pharmaceutical compositions in accordance with the present disclosure may be administered at dosage levels sufficient to deliver from about 0.0001 mg/kg to about 100 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect. The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the present invention. For example, in certain embodiments, doses may be adjusted based on pharmacokinetic or pharmacodynamic parameters, which may include clinical effects such as toxic effects and/or laboratory values. Thus, the present invention encompasses intra-patient dose-escalation as determined by the skilled artisan. Determining appropriate dosages and regiments for administration of the chemotherapeutic agent are well-known in the relevant art and would be understood to be encompassed by the skilled artisan once provided the teachings disclosed herein.

Effective dose parameters: The dosage regimen of the (modified) GFR-binding compounds or functionalised bioactive carriers and/or pharmaceutical compositions as defined herein may be adjusted to obtain effective dose parameters. Effective dose parameters can be determined using methods standard in the art for a particular disease or condition. In particular, the effectiveness of dose parameters of a therapeutic composition as defined herein can be determined by assessing response rates. Such response rates refer to the percentage of treated patients in a population of patients that respond with either partial or complete remission.

A pharmaceutical composition as defined herein may be prepared, packaged, or sold in bulk, as a single unit dose, or as a plurality of single unit doses.

Unit dose: As used herein, unless indicated otherwise or contradictory in context, the term "unit dose" refers to a discrete amount of the pharmaceutical composition comprising a predetermined amount of the active ingredient. The amount of the active ingredient is generally equal to the dosage of the active ingredient which would be administered to a subject or a convenient fraction of such a dosage such as, for example, in certain embodiments, one-half or one-third of such a dosage.

Single unit dose: As used herein, unless indicated otherwise or contradictory in context, the term "single unit dose" refers to a dose of any therapeutic association or composition administered in one dose/at one time/single route/single point of contact, i.e., single administration event.

Split dose: As used herein, unless indicated otherwise or contradictory in context, the term "split dose" refers to the division of single unit dose or total daily dose into two or more doses.

Total daily dose: As used herein, unless indicated otherwise or contradictory in context, the term "total daily dose" refers to an amount given or prescribed in 24 hr period. It may be administered as a single unit dose.

The relative amounts of the active ingredient(s), the pharmaceutically acceptable excipients, carriers or vehicles, and any additional ingredients in a pharmaceutical composition defined herein will vary, depending upon the identity, size, and condition of the subject treated and further depending upon the route by which the composition is to be administered. In addition to the active ingredient, a pharmaceutical composition of the invention may further comprise one or more additional pharmaceutically active agents.

Combination therapy: Compounds, associations, compositions or formulations defined herein may be used in combination with one or more other therapeutic, prophylactic, diagnostic, or imaging agents. As used herein, the term "in combination with" is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In some embodiments, they are administered within about 90, 60, 30, 15, 10, 5, or 1 minute of one another. In some embodiments, the administrations of the agents are spaced sufficiently closely together such that a combinatorial (e.g., a synergistic) effect is achieved. In general, each agent will be administered at a dose and/or on a time schedule determined for that agent. In one example, the present disclosure encompasses the delivery of pharmaceutical, prophylactic, diagnostic, or imaging compositions in combination with agents that improve their bioavailability, reduce and/or modify their metabolism, inhibit their excretion, and/or modify their distribution within the body. It will further be appreciated that therapeutically, prophylactically, diagnostically, or imaging active agents used in combination may be administered together in a single composition or administered separately in different compositions. In general, it is expected that agents used in combination with be used at levels that do not exceed the levels at which they are used individually. In one example, the levels used in combination will be lower than those utilized individually. The particular combination of therapies to employ in a combination regimen will take into account compatibility of the desired therapeutics and/or procedures and the desired therapeutic effect to be achieved. It will also be appreciated that the therapies employed may achieve a desired effect for the same disorder, or they may achieve different effects (e.g., control of any adverse effects).

Although the descriptions of pharmaceutical compositions provided herein are principally directed to pharmaceutical compositions which are suitable for administration to mammals, in particular humans, it will be understood by the skilled artisan that such compositions are generally suitable for administration to animals of all sorts, in particular to any member of the Vertebrate class. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as chickens, ducks, geese, and/or turkeys.

XIII. Dermatological Applications

When the cell or tissue to be regenerated, repaired or treated is a skin cell or tissue (mainly from the fibroblast lineage), the pharmaceutical composition defined herein may be a dermatological composition comprising at least one (modified) GFR-binding compound or at least one functionalised bioactive carrier, as all defined herein, and at least one dermatologically acceptable excipient.

For example, in certain embodiments, a dermatological composition for the uses of the invention may contain between 0.01% and 100% by weight (over the total weight of the dermatological composition) of a GFR-binding compound or functionalised bioactive carrier, both as defined herein, as a dermatological effective amount. The dermatological composition particularly comprises between 0.01% and 95%, between 0.01% and 90%, between 0.01% and 85%, between 0.01% and 80%, between 0.01% and 75%, between 0.01% and 70%, between 0.01% and 65%, between 0.01% and 60%, between 0.01% and 55%, between 0.01% and 50%, between 0.01% and 45%, between 0.01% and 40%, between 0.01% and 35%, between 0.01% and 30%, between 0.01% and 25%, between 0.01% and 20%, between 0.01% and 15%, between 0.01% and 10%, between 0.01% and 5%, between 0.1% and 100%, between 0.1% and 95%, between 0.1% and 90%, between 0.1% and 85%, between 0.1% and 80%, between 0.1% and 75%, between 0.1% and 70%, between 0.1% and 65%, between 0.1% and 60%, between 0.1% and 55%, between 0.1% and 50%, between 0.1% and 45%, between 0.1% and 40%, between 0.1% and 35%, between 0.1% and 30%, between 0.1% and 25%, between 0.1% and 20%, between 0.1% and 15%, between 0.1% and 10%, and between 0.1% and 5% by weight (over the total weight of the dermatological composition) of any one of a GFR-binding compound or a functionalised bioactive carrier.

Dermatologically acceptable: As used herein, unless indicated otherwise or contradictory in context, the term "dermatologically acceptable" means that the compound(s) or pharmaceutical association(s) used are adapted for use in contact with human skin without undue toxicity, incompatibility, instability, allergic response, or their equivalents.

Dermatological formulations: Suitable formulation for implementing dermatological embodiments of the invention include an aqueous or oil-based solution, a water-based cream or gel or an oily gel, usually in a jar or a tube, particularly a shower gel, shampoo, milk, emulsion, microemulsion or nanoemulsion, particularly oil-in-water or water-in-oil or multiple of silicone-based; a lotion, particularly in a glass or plastic bottle of a spray or aerosol bottle, a blister-pack, liquid soap, a dermatological bar of soap, a pomade, mousse, an anhydrous product, preferably liquid, cream or solid, for example in the form of a stick, particularly in the form of lipstick, a cataplasm or a patch.

Preferred administration routes include, but are not limited to, oral, topical or intradermal as already defined herein.

Dermatologically acceptable excipients: Suitable dermatologically acceptable excipients for implementing embodiments of the invention include, but are not limited to, preservatives, emollients, emulsifiers, surfactants, moisturizers, thickeners, conditioners, mattifying agents, stabilizers, antioxidants, texturizing agents, shine agents, filmogenic agents, solubilizers, pigments, colorants, perfumes, and solar filters. These excipients are preferably chosen from among the group consisting of amino acids and their derivatives, polyglycerols, esters, polymers and cellulose derivatives, lanoline derivatives, phospholipids, lactoferrins, lactoperoxidases, sucrose-based stabilizers, vitamin E and its derivatives, natural and synthetic waxes, vegetable oils, triglycerides, insaponifiables, phytosterols, plant esters, silicones and their derivatives, protein hydrolysates, jojoba oil and its derivatives, lipo/hydrosoluble esters, betaines, aminoxides, saccharose ester plant extracts, titanium dioxides, glycines, parabens, and even more preferably from among the group consisting of butylene glycol, glycol-15 stearyl ether, cetearyl alcohol, phenoxyethanol, methylparaben, propylparaben, butylparaben, butylenes glycol, natural tocopherols, glycerine, dihydroxycetyl sodium phosphate, isopropyl hydroxycetyl ether, le glycol stearate, triisononanoin, octyl cocoate, polyacrylamide, isoparaffin, laureth-7, carbomer, propylene glycol, glycerol, bisabolol, dimethicone, sodium hydroxide, PEG 30-dipolyhydroxysterate, capric/caprylic triglycerides, cetearyl octanoate, dibutyl adipate, grapeseed oil, jojoba oil, magnesium sulfate, EDTA, cyclomethicone, xanthan gum, citric acid, sodium lauryl sulfate, mineral waxes and oils, isostearyl isostearate, dipelargonate of propylene glycol, isostearate of propylene glycol, PEG 8, beeswax, glyceride of hydrogenated palm kernel oil, lanolin oil, sesame oil, cetyl lactate, lanolin alcohol, titanium dioxide, lactose, saccharose, low-density polyethylene, and isotonic salt solution.

In one example, the dermatological composition as defined herein may contain at least one other active agents and/or excipients and/or additives of pharmaceutical, especially dermatological, interest such as agents with the following properties:

wound-healing properties; such as panthenol and derivatives thereof, for example ethyl panthenol, aloe vera, pantothenic acid and derivatives thereof, allantoin, bisabolol, and dipotassium glycyrrhizinate;

anti-inflammatory properties: such as steroidal and non-steroidal antiinflammatories, in particular Inhibitors of the production of cytokines and chemokines, of cyclooxygenase, of nitric oxide (NO) and nitric oxide synthase (NOS). As an example of anti-inflammatory products, mention may be made of extracts of *Ginkgo biloba*, trilactone terpenes such as ginkgolides, especially ginkgolide B and bilobalide known for their platelet-activating factor (PAF) antagonist properties.

The CTFA Cosmetic Ingredient Handbook, Second Edition (1992), which is hereby incorporated by reference in its entirety, describes different cosmetic and pharmaceutical ingredients currently used in the cosmetic and pharmaceutical industry that are particularly adapted to topical use and which may be used in a dermatological composition of the invention. Examples of these types of ingredients include but are not limited to the following compounds: abrasives, absorbent compounds, compounds with aesthetic purposes such as perfumes, pigments, colorants, essential oils, astringents, etc. (for example: clove oil, menthol, camphor, eucalyptus oil, eugenol, menthyl lactate, and hamelis distillate), anti-acne agents, anti-flocculant agents, anti-foaming agents, anti-microbial agents (for example iodopropyl butylcarbamate), les antioxidants, bonding agents, biological additives, tampon agents, swelling agents, chelatants, additives, biocidal agents, denaturants, external analgesics, film-forming materials, polymers, opacifying agents, pH adjusters, reducing agents, depigmenting or lightening agents (for example: hydroquinone, kojic acid, ascorbic acid, magnesium ascorbyl phosphate, ascorbyl glucosamine), conditioning agents (for example: humectants), calming agents for the skin and/or scarring agents (for example: panthenol and its derivatives, for example ethyl panthenol), aloe vera, pantothenic acid and its derivatives, allantoin, bisabolol and dipotassium glycyrrhizinate), thickeners, vitamins, and the derivatives or equivalents of these.

In one aspect, the present disclosure provides a (modified) GFR-binding compound, a functionalised bioactive carrier, or a dermatological composition, all as defined herein, for use in preventing and/or treating scars and/or inflammations such as gingivitis.

In one particular example, the dermatological composition is intended for treating skin in which the dermis is at least partially damaged, especially in subjects who have undergone a surgical operation, or who have been burned and/or injured. This treatment makes it possible to stimulate the proliferation and/or the activity of fibroblasts, in order to stimulate tissue repair and/or dermal reconstruction.

In one aspect, the present disclosure provides a (modified) GFR-binding compound, a functionalised bioactive carrier, or a dermatological composition, all as defined herein, for use in preventing and/or treating at least one of acne, alopecia areata, bowen's disease, congenital erythropoietic porphyria, contact dermatitis, darier's disease, eczema (atopic eczema), epidermolysis bullosa simplex, erythropoietic protoporphyria, fungal infections of nails, hailey-hailey disease, herpes simplex, hidradenitis suppurativa, hirsutism, hyperhidrosis, ichthyosis, impetigo, keloids, keratosis pilaris, lichen planus, lichen sclerosus, melasma, pemphigus vulgaris, plantar warts (verrucas), pityriasis lichenoides, polymorphic light eruption, psoriasis, pyoderma gangrenosum, rosacea, scabies, shingles and vitiligo.

In one aspect, the present disclosure also provides a dermatological care or treatment method for a subject having need thereof, said method comprising the topical application, intradermal injection or oral administration, preferably the topical application or the intradermal injection, of a (suitable amount of) at least one (modified) GFR-binding compound, functionalised bioactive carrier, or dermatological composition, all as defined herein.

Such a dermatological care or treatment method includes the applications cited herein.

Suitable as amounts of (modified) GFR-binding compounds or functionalised bioactive carrier for implementing embodiments of the invention in the dermatological field include the group consisting of between about 0.0001 µg/day to about 5000 mg/day, between about 0.0001 µg/day to about 1000 mg/day, between about 0.0001 µg/day to about 10 mg/day, between about 0.0001 µg/day to about 1 mg/day, or between about 0.0001 µg/day to about 100 µg/day, all being preferred for implementing embodiments of the invention.

Advantageously, the subject who has need thereof is a subject chosen from a population having an average age of more than 30 years old or who has had sunlight overexposure, has a family history of skin conditions.

XIV. Ophthalmic Applications

Preferable dosage forms for the (modified) GFR-binding compound functionalised bioactive carrier or pharmaceutical composition, all as defined herein, for treating eye retina diseases, disorders or conditions include, for example, in certain embodiments, eye drops and eye ointments. These can be prepared using conventional techniques. For instance, eye drops may be prepared, using isotonic agents such as sodium chloride, buffers such as sodium phosphate, and preservatives such as benzalkonium chloride. A suitable pH is within an ophthalmologically acceptable range. Preferred pH is within pH 4 to 8.

Particularly preferred administration routes include vitreal and intraocular.

A suitable dose of (modified) GFR-binding compound, functionalised bioactive carrier, or pharmaceutical composition for treating eye disorders is appropriately selected, depending on the symptoms, age of patients, dosage form and the like. For eye drops, suitable concentration may be 0.0001 to 10 w/v %, preferably 0.0001 to 0.01 w/v % for administration into eyes once or several times a day.

XV. Surgical Treatments

The (modified) GFR-binding compounds, functionalised bioactive carriers, and pharmaceutical compositions, all as defined herein, may be used in surgical methods suitable for protecting (e.g. treating or preventing) a patient or subject from a disease, condition, disorder or pathology to whom a surgical intervention would be beneficial.

For example, in certain embodiments, said surgical method may be selected from the group consisting of bone-repair surgery, cartilage-repair surgery, heart surgery, kidneys or lung surgery, eye surgery, muscle-repair surgery, and tendon/ligament-repair surgery.

In one aspect, the present invention thus discloses a surgical method for surgical treatment comprising the contacting of at least one (modified) GFR-binding compound, at least one functionalised bioactive carrier, a pharmaceutical, prophylactic, diagnostic or imaging composition thereof, or medical device, all as defined herein, with a body part of a patient to be treated, wherein said contacting induces stem cell differentiation and tissue formation.

In one example, said surgical method comprises the placement or implantation of an implantable medical device comprising a (modified) GFR-binding compound, a functionalised bioactive carrier, or a pharmaceutical, prophylactic, diagnostic or imaging composition thereof, all as defined herein, inside a patient or subject in need of such a surgical treatment.

For example, in certain embodiments, the surgical treatment of the invention may include the use of a placement, insertion or depositing device for contacting said GFR-binding compound, said functionalised bioactive carrier, or a pharmaceutical, prophylactic, diagnostic or imaging composition thereof with a body part of a patient or subject in need of such a treatment. In one example, said placement, insertion or depositing device comprises an injection device such as a syringe.

In certain embodiments, said surgical method comprises the positioning of a GFR-binding compound, a functionalised bioactive carrier, or a pharmaceutical, prophylactic, diagnostic or imaging composition thereof, all as defined herein, inside said injection device for injection into a patient or into a body part of a patient.

In one example, said medical device comprises titanium and/or PEEK and/or PET and/or hydrogel and/or ceramic. In one particular example, said medical device replaces part of or all of a body part of a patient or subject. In one example, said body part is a malfunctioning or damaged body part such as, for instance, a bone, the skin, the hair scalp, an eye, etc.

XVI. Pharmaceutical Applications, Uses and Methods

Some growth factors interact with type I and II growth factor receptors belonging to the serine threonine kinase family. Conventionally, to mediate signaling pathways, growth factors interact with these receptors by forming specific dimeric or oligomeric structures. The type-II receptor, which is constitutively active, phosphorylates the type-I receptor, which then activates the transduction pathway Smad1/5/8. Receptors of both types are thus conventionally needed to form a functional complex in order to initiate further signaling events. Phosphorylated Smads then dissociate from the receptors and bind Smad4, a common mediator, leading to nuclear translocation, regulation of specific genes, and eventually may induce tissue regeneration.

Prior in-vitro and in-vivo scientific studies have reported that influencing the natural/conventional biology of human mesenchymal stem cells using exogenous entity or molecules such as recombinant growth factor proteins or peptide fragments thereof, may have an effect on cell differentiation and tissue regeneration. A (modified) GFR-binding compound or a functionalised bioactive carrier of the present disclosure may be one such exogenous entity or molecule.

For example, in certain embodiments, medical treatments may demonstrate the effect of the influence of an exogenous entity or molecule on human mesenchymal stem cells using a medical device onto or into which such an exogenous entity or molecule has been reversibly or irreversibly incorporated or deposited, both being equally preferred, and placed into a patient in need thereof.

In one example, medical treatments may provide the effect of the influence of an exogenous entity or molecule on human mesenchymal stem cells using a pharmaceutical composition containing such an exogenous entity or molecule and a pharmaceutically acceptable excipient or carrier, administered, for instance, orally, enterically, intravenously, peritoneally, subcutaneously, transdermally, parenterally, or rectally, to a patient in need of such a treatment.

As already stated herein, for in-vivo administration, compounds or compositions of the present invention may be injected at a target site so that they can be delivered in close proximity to the cells to be treated via, e.g. a PTD or cell-permeable peptide. Alternately, an implant (or medical device or implantable medical device) comprising a PTD/GFR-binding compound complex may be used.

The present invention generally provides for uses and methods of inducing mesenchymal stem cell or progenitor cell (at any stage of differentiation) differentiation and/or inducing, promoting, enhancing, controlling or regulating tissue regeneration/formation in-vitro, ex-vivo and in-vivo.

Conveniently, such a tissue formation process is generally achieved within less than 7 days. In particular, such a tissue formation process is generally achieved within less than 6 days. In particular, such a tissue formation process is generally achieved within less than 5 days. In particular, such a tissue formation process is generally achieved within less than 4 days. In particular, such a tissue formation process is generally achieved within less than 3 days. In particular, such a tissue formation process is generally achieved within less than 2 days. In particular, such a tissue formation process is generally achieved within less than 24 hours. In particular, such a tissue formation process is generally achieved within less than 18 hours.

In one aspect, the present disclosure provides a pharmaceutical (therapeutic, dermatologic, ophthalmologic, diagnostic, etc.) composition as defined herein for use in a method of non-mutagenically inducing tissue formation i.e. without modifying or altering the genome of the treated cells, in-vitro, ex-vivo or in-vivo. Also provided is a method of inducing tissue formation i.e. without modifying or altering the genome of the treated cells, comprising the in-vitro, ex-vivo or in-vivo administration of an effective amount of a (modified) GFR-binding compound, a functionalised bioactive carrier, or a pharmaceutical (therapeutic, dermatologic, ophthalmologic, diagnostic, etc.) composition as defined herein.

In one aspect, the present disclosure provides a pharmaceutical (therapeutic, dermatologic, ophthalmologic, diagnostic, etc.) composition as defined herein for use in a method of extracellular induction of tissue formation. Also provided is a method of extracellular tissue formation induction, comprising the in-vitro, ex-vivo or in-vivo administration of an effective amount of a (modified) GFR-binding compound, a functionalised bioactive carrier, or a pharmaceutical (therapeutic, dermatologic, ophthalmologic, diagnostic, etc.) composition as defined herein.

An extracellular treatment as used herein implies a biological action/effect to be provided or to occur outside the cell to be treated (i.e. a mesenchymal stem cell). In other words, the biologically active agent (e.g. the GFR-binding compound or the pharmaceutical composition as defined herein) delivers/provides its biological/pharmaceutical effect to the outside of the cell (e.g. on the cell's surface) without the need to penetrate through the cell membrane, inside the cell to be treated. Once the extracellular action/effect has been administered/delivered to the cell to be treated, said active agent may be, for instance, excreted from the host organism with or without being metabolised, and/or tagged to be destroyed through apoptotic routes, and/or internalised by nearby cells, etc. . . .

In one aspect, the present disclosure provides a method of producing a physiologically functional and healthy cell, comprising the administration in-vitro, ex-vivo or in-vivo to a mesenchymal stem cell or progenitor cell (at any stage of differentiation) of an effective amount of a (modified) GFR-binding compound, a functionalised bioactive carrier, or a pharmaceutical (therapeutic, dermatologic, ophthalmologic, diagnostic, etc.) composition as defined herein and wherein said physiologically functional and healthy cell is selected from the group consisting of an osteoblast, osteocyte, chondroblast, chondrocyte, neuroblast, neurocyte, Sertoli cells, Leydig cell, Germ cell, Myoblast, Myocyte, keratinocyte, endothelial cells, angioblast, fibroblast, fibrocyte, podocyte, areolar connective cells, adipocytes, pre-adipocytes/lipoblasts, epithelial cells, erythrocytes, alveolar cells, hematopoietic stem cells (HSC), myeloid progenitors, lymphoid progenitors, mast cells, myeloblasts, monocytes, macrophages, neutrophils, basophils, eosinophils, erythrocytes, megakaryocytes, thrombocytes, dendritic cells, small lymphocytes, T-lymphocytes (T-cells), B-lymphocytes (B-cells), and natural killer (NK)-cells.

In one aspect, the present disclosure provides methods to activate a growth factor receptor present on the surface of a mesenchymal stem cell or progenitor cell (at any stage of differentiation), said method comprising administering to said mesenchymal stem cell or progenitor cell (at any stage of differentiation) an effective amount of a (modified) GFR-binding compound, a functionalised bioactive carrier, or a pharmaceutical (therapeutic, dermatologic, ophthalmologic, diagnostic, etc.) composition as defined herein, wherein administering said GFR-binding compound, a functionalised bioactive carrier, or a pharmaceutical (therapeutic, dermatologic, ophthalmologic, diagnostic, etc.) composition as defined herein activates the growth factor receptor present on the surface of the mesenchymal stem cell or progenitor cell (at any stage of differentiation).

In one aspect, the present disclosure provides methods of delivering a (modified) GFR-binding compound, a functionalised bioactive carrier, or a pharmaceutical (therapeutic, dermatologic, ophthalmologic, diagnostic, etc.) composition, all as defined herein, in-vitro, ex-vivo or in-vivo to a mesenchymal stem cell or progenitor cell (at any stage of differentiation), comprising the contacting of said mesenchymal stem cell or progenitor cell (at any stage of differentiation) with said (modified) GFR-binding compound, a functionalised bioactive carrier, or a pharmaceutical (therapeutic, dermatologic, ophthalmologic, diagnostic, etc.) composition.

In one aspect, the present disclosure provides methods of administering a (modified) GFR-binding compound, a functionalised bioactive carrier, or a pharmaceutical (therapeutic, dermatologic, ophthalmologic, diagnostic, etc.) composition, all as defined herein, to a patient or subject comprising the contacting of at least one body part of said patient or subject with said (modified) GFR-binding compound, a functionalised bioactive carrier, or a pharmaceutical (therapeutic, dermatologic, ophthalmologic, diagnostic, etc.) composition.

In one example, the (modified) GFR-binding compound, functionalised bioactive carrier, or pharmaceutical (therapeutic, dermatologic, ophthalmologic, diagnostic, etc.) composition, all as defined herein, may be a mammal (preferably a human) tissue-inductive compound, bioactive carrier or composition, which has demonstrated the ability to induce tissue formation in vitro and/or in vivo.

In one aspect, the present disclosure provides an effective amount of at least one (modified) GFR-binding compound, at least one functionalised bioactive carrier, or at least one pharmaceutical (therapeutic, dermatologic, ophthalmologic, diagnostic, etc.) composition, all as defined herein, for use in a medical method such as in therapy, surgery or in diagnostic methods.

In one aspect, the present disclosure provides a method of inducing or promoting or enhancing mesenchymal stem cell or progenitor cell (at any stage of differentiation) differentiation, the method comprising administering to the cell an effective amount of at least one (modified) GFR-binding compound, at least one functionalised bioactive carrier, or at least one pharmaceutical (therapeutic, dermatologic, ophthalmologic, diagnostic, etc.) composition, all as defined herein. In one aspect, the present invention discloses an effective amount of at least one (modified) GFR-binding compound, at least one functionalised bioactive carrier, or at least one pharmaceutical (therapeutic, dermatologic, ophthalmologic, diagnostic, etc.) composition, all as defined herein, for use in a method of inducing or promoting or enhancing mesenchymal stem cell or progenitor cell (at any stage of differentiation) differentiation In one aspect, the present disclosure provides a method of inducing or promoting or enhancing or controlling or regulating tissue regeneration/formation, the method comprising administering to a mesenchymal stem cell or to a progenitor cell at any stage of differentiation or to a mature cell an effective amount of at least one (modified) GFR-binding compound, at least one functionalised bioactive carrier, or at least one pharmaceutical (therapeutic, dermatologic, ophthalmologic, diagnostic, etc.) composition, all as defined herein. In one aspect, the present invention discloses an effective amount of at least one (modified) GFR-binding compound, at least one functionalised bioactive carrier, or at least one pharmaceutical (therapeutic, dermatologic, ophthalmologic, diagnostic, etc.) composition, all as defined herein, for use in a method of inducing or promoting or enhancing or controlling or regulating tissue regeneration/formation.

In one aspect, the present disclosure provides a method of inducing and/or promoting and/or enhancing cell motility or single/collective cell migration, the method comprising administering to a mesenchymal stem cell or to a progenitor cell at any stage of differentiation or to a mature cell an effective amount of at least one (modified) GFR-binding compound, at least one functionalised bioactive carrier, or at least one pharmaceutical (therapeutic, dermatologic, ophthalmologic, diagnostic, etc.) composition, all as defined herein. In one aspect, the present invention discloses an effective amount of at least one (modified) GFR-binding compound, at least one functionalised bioactive carrier, or at least one pharmaceutical (therapeutic, dermatologic, ophthalmologic, diagnostic, etc.) composition, all as defined herein, for use in a method of inducing and/or promoting and/or enhancing cell motility or single/collective cell migration.

In one aspect, the present invention discloses a method of inducing and/or promoting and/or enhancing cell maturation, the method comprising administering to a differentiated cell or to a mature cell an effective amount of at least one (modified) GFR-binding compound, at least one functionalised bioactive carrier, or at least one pharmaceutical (therapeutic, dermatologic, ophthalmologic, diagnostic, etc.) composition, all as defined herein. In one aspect, the present invention discloses an effective amount of at least one (modified) GFR-binding compound, at least one functionalised bioactive carrier, or at least one pharmaceutical (therapeutic, dermatologic, ophthalmologic, diagnostic, etc.) composition, all as defined herein, for use in a method of inducing and/or promoting and/or enhancing cell maturation.

In one example, the (modified) GFR-binding compound, functionalised bioactive carrier, or pharmaceutical (therapeutic, dermatologic, ophthalmologic, diagnostic, etc.) composition, all as defined herein, may be combined/mixed with adult stem cells and/or multipotent progenitor cells prior to be administered or implanted into a mammal (preferably a human) to promote tissue regeneration.

In one example, the (modified) GFR-binding compound, functionalised bioactive carrier, or pharmaceutical (therapeutic, dermatologic, ophthalmologic, diagnostic, etc.) composition, all as defined herein, may be administered as such and may be combined/mixed with adult stem cells and/or multipotent progenitor cells prior to administration to a mammal (preferably a human) to promote tissue regeneration.

In particular, medical applications which may result from the mediation of type I and II growth factor receptors by a (modified) GFR-binding compound, functionalised bioactive carrier, or pharmaceutical (therapeutic, dermatologic, ophthalmologic, diagnostic, etc.) composition, all as defined herein, include, but are not limited to, enhancing of osteogenesis, inducing bone formation, inducing osteocyte maturation, and/or treating and/or preventing osteoporosis.

In one example, a (modified) GFR-binding compound, functionalised bioactive carrier, or pharmaceutical (therapeutic, dermatologic, ophthalmologic, diagnostic, etc.) composition, all as defined herein, may thus be an osteoinductive compound, bioactive carrier or composition which has demonstrated an ability to induce bone formation in vitro and/or ex-vivo and/or in vivo.

In one aspect, the present disclosure thus provides:

- a method of inducing or promoting or enhancing mesenchymal stem cell, progenitor osteoblast (at any stage of differentiation of the Osteoblast cell lineage) differentiation, the method comprising administering to the cell an effective amount of at least one (modified) GFR-binding compound, at least one functionalised bioactive carrier, or at least one pharmaceutical composition, all as defined herein;
- a method of inducing or promoting or enhancing or controlling or regulating bone tissue regeneration/formation, the method comprising administering to a mesenchymal stem cell or to a progenitor osteoblast at any stage of differentiation of the osteoblast cell lineage or to a mature osteoblast, an effective amount of at least one (modified) GFR-binding compound, at least one functionalised bioactive carrier, or at least one pharmaceutical composition, all as defined herein;
- a method of inducing and/or promoting and/or enhancing osteocyte maturation, the method comprising administering to a differentiated osteoblast or to a mature osteoblast (e.g. an osteocyte) an effective amount of at least one (modified) GFR-binding compound, at least one functionalised bioactive carrier, or at least one pharmaceutical composition, all as defined herein;
- an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor osteoblast (at any stage of differentiation of the osteoblast cell lineage) differentiation;
- an effective amount of at least one (modified) GFR-binding compound, at least one functionalised bioactive carrier, or at least one pharmaceutical composition, all as defined herein for use in a method of inducing or promoting or enhancing or controlling or regulating bone tissue regeneration/formation;
- an effective amount of at least one (modified) GFR-binding compound, at least one functionalised bioactive carrier, or at least one pharmaceutical composition, all as defined herein for use in a method of inducing and/or promoting and/or enhancing osteoblast maturation.

In particular, medical applications which may result from the mediation of type I and II growth factor receptors by a (modified) GFR-binding compound, functionalised bioactive carrier, or pharmaceutical (therapeutic, dermatologic, ophthalmologic, diagnostic, etc.) composition, all as defined herein, include, but are not limited to, enhancing of chondrogenesis and/or inducing cartilage formation, and/or inducing chondrocyte maturation and/or treating and/or preventing at least one of osteoarthritis, costochondritis, Herniation, achondroplasia or relapsing polychondritis.

In one example, a (modified) GFR-binding compound, functionalised bioactive carrier, or pharmaceutical (therapeutic, dermatologic, ophthalmologic, diagnostic, etc.) composition, all as defined herein, may be a chondroinductive compound, bioactive carrier or composition which has demonstrated the ability to induce cartilage formation in vitro and/or ex-vivo and/or in vivo.

In one aspect, the present disclosure thus provides:

- a method of inducing or promoting or enhancing mesenchymal stem cell, progenitor chondroblast (at any stage of differentiation of the chondrocytic cell lineage) differentiation, the method comprising administering to the cell an effective amount of at least one (modified) GFR-binding compound, at least one functionalised bioactive carrier, or at least one pharmaceutical composition, all as defined herein;
- a method of inducing or promoting or enhancing or controlling or regulating cartilage tissue regeneration/formation, the method comprising administering to a mesenchymal stem cell or to a progenitor chondroblast (at any stage of differentiation of the chondrocytic cell lineage) or to a mature chondroblast, an effective amount of at least one (modified) GFR-binding compound, at least one functionalised bioactive carrier, or at least one pharmaceutical composition, all as defined herein;
- a method of inducing and/or promoting and/or enhancing chondrocyte maturation, the method comprising administering to a differentiated chondroblast or to a mature osteoblast (e.g. a chondrocyte) an effective amount of at least one GFR-binding compound, at least one functionalised bioactive carrier, or at least one pharmaceutical composition, all as defined herein;
- an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor chondroblast (at any stage of differentiation of the chondrocytic cell lineage) differentiation;
- an effective amount of at least one (modified) GFR-binding compound, at least one functionalised bioactive carrier, or at least one pharmaceutical composition, all as defined herein for use in a method of inducing or promoting or enhancing or controlling or regulating cartilage tissue regeneration/formation;
- an effective amount of at least one (modified) GFR-binding compound, at least one functionalised bioactive carrier, or at least one pharmaceutical composition, all as defined herein for use in a method of inducing and/or promoting and/or enhancing chondroblast maturation.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing of endothelization and/or vascularization/angiogenesis and/or treating and/or preventing at least one of coronary artery disease (also known as coronary heart disease and ischemic heart disease), cardiomyopathy, hypertensive heart disease, heart failure, cor pulmonale, cardiac dysrhythmias, inflammatory heart disease, endocarditis, inflammatory cardiomegaly, myocarditis, valvular heart disease, cerebrovascular disease, peripheral arterial disease, congenital heart disease, or rheumatic heart disease.

In one example, a GFR-binding compound, functionalised bioactive carrier, or pharmaceutical (therapeutic, dermatologic, ophthalmologic, diagnostic, etc.) composition, all as defined herein, may be an endothelization/vascularization/angiogenesis-promoting compound, bioactive carrier or composition which has demonstrated the ability to induce vascular tissue formation in vitro and/or ex-vivo and/or in vivo.

In one aspect, the present disclosure thus provides:

a method of inducing or promoting or enhancing mesenchymal stem cell, progenitor endothelial cell (at any stage of differentiation of the vascular cell lineage) differentiation, the method comprising administering to the cell an effective amount of at least one (modified) GFR-binding compound, at least one functionalised bioactive carrier, or at least one pharmaceutical composition, all as defined herein;

a method of inducing or promoting or enhancing or controlling or regulating vascular tissue regeneration/formation and/or tubular formation, the method comprising administering to a mesenchymal stem cell or to a progenitor endothelial cell at any stage of differentiation of the vascular cell lineage or to a mature endothelial cell, an effective amount of at least one (modified) GFR-binding compound, at least one functionalised bioactive carrier, or at least one pharmaceutical composition, all as defined herein;

a method of inducing and/or promoting and/or enhancing cell motility or single/collective endothelial cell migration and/or angiogenesis, the method comprising administering to a mesenchymal stem cell or to a progenitor endothelial cell at any stage of differentiation of the vascular cell lineage or to a mature endothelial cell an effective amount of at least one (modified) GFR-binding compound, at least one functionalised bioactive carrier, or at least one pharmaceutical composition, all as defined herein.

a method of inducing and/or promoting and/or enhancing endothelial cell maturation, the method comprising administering to a differentiated endothelial cell or to a mature endothelial cell an effective amount of at least one (modified) GFR-binding compound, at least one functionalised bioactive carrier, or at least one pharmaceutical composition, all as defined herein;

an effective amount of at least one (modified) GFR-binding compound, at least one functionalised bioactive carrier, or at least one pharmaceutical composition, all as defined herein for use in a method of inducing or promoting or enhancing mesenchymal stem cell, progenitor endothelial cell (at any stage of differentiation of the vascular cell lineage) differentiation;

an effective amount of at least one (modified) GFR-binding compound, at least one functionalised bioactive carrier, or at least one pharmaceutical composition, all as defined herein for use in a method of inducing or promoting or enhancing or controlling or regulating vascular tissue regeneration/formation and/or tubular formation;

an effective amount of at least one (modified) GFR-binding compound, at least one functionalised bioactive carrier, or at least one pharmaceutical composition, all as defined herein for use in a method of inducing and/or promoting and/or enhancing cell motility or single/collective endothelial cell migration and/or angiogenesis, an effective amount of at least one (modified) GFR-binding compound, at least one functionalised bioactive carrier, or at least one pharmaceutical composition, all as defined herein for use in a method of inducing and/or promoting and/or enhancing endothelial cell maturation.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing axonal dendritic neuron growth thus promoting neuron-regeneration and/or treating and/or preventing and/or decreasing or suppressing neuron degeneration-related conditions and diseases.

In the present description and unless otherwise indicated, the term "neuron-regeneration" or "neuroregeneration" means the regrowth or repair of nervous tissues, cells or cell products involving the participation of stem cells. Such mechanisms may include generation of new neurons, glia, axons, myelin, or synapses. Neurological disorders in which the present invention may thus be useful include, but are not limited to, ALS, Agraphia Alzheimer's disease, Amyotrophic lateral sclerosis, Angle man syndrome, Aphasia Apraxia, Arachnoiditis, Ataxia Telangiectasia, Attention deficit hyperactivity disorder, Auditory processing disorder, Autism, Alcoholism, asperger's syndrome, Bipolar disorder, Bell's palsy, Brachial plexus injury, Brain damage, Brain injury, Canavan disease, Capgras delusion, Causalgia, Central pain syndrome, Central pontine myelinolysis, Centronuclear myopathy, Cephalic disorder, Cerebral aneurysm, Cerebral arteriosclerosis, Cerebral atrophy, Cerebral gigantism, Cerebral palsy, Cerebral vasculitis, Cervical spinal stenosis, Charcot-Marie-Tooth disease, Chiari malformation, Chorea, Chronic fatigue syndrome, Chronic inflammatory demyelinating polyneuropathy (CIDP), Chronic pain, Coffin-Lowry syndrome, Coma, Complex regional pain syndrome, Compression neuropathy, Congenital facial diplegia, Corticobasal degeneration, Cranial arteritis, Craniosynostosis, Creutzfeldt-Jakob disease, Cumulative trauma disorders, Cushing's syndrome, Cytomegalic inclusion body disease (CIBD), Cytomegalovirus Infection, Dandy-Walker syndrome, Dawson disease, De Morsier's syndrome, Dejerine-Klumpke palsy, Dejerine-Sottas disease, Delayed sleep phase syndrome, Dementia, Dermatomyositis, Developmental coordination disorder, Diabetic neuropathy, Diffuse sclerosis, Downs syndrome, Dravet syndrome, Dysautonomia, Dyscalculia, Dysgraphia, Dyslexia, Dystonia, Empty sella syndrome, Encephalitis, Encephalocele, Encephalotrigeminal angiomatosis, Encopresis, Epilepsy, Erb's palsy, Erythromelalgia, Essential tremor, Fabry's disease, Fahr's syndrome, Fainting, Familial spastic paralysis, Febrile seizures, Fisher syndrome, Friedreich's ataxia, Fibromyalgia, Foville's syndrome, Fetal alcohol syndrome, Fragile X Tremor Ataxia Syndrome, Gaucher's disease, Gerstmann's syndrome, Giant cell arteritis, Giant cell inclusion disease, Globoid Cell Leukodystrophy, Gray matter heterotopia, Guillain-Barré syndrome, HTLV-1 associated myelopathy, Hallervorden-Spatz disease, Head injury, Headache, Hemifacial Spasm, Hereditary Spastic Paraplegia, Heredopathia atactica polyneuritiformis, Herpes zoster oticus, Herpes zoster, Hirayama syndrome, Holoprosencephaly, Huntington's disease, Hydranencephaly, Hydrocephalus, Hypercortisolism, Hypoxia, Immune-Mediated encephalomyelitis, Inclusion body myositis, Incontinentia pigmenti, Infantile Refsum disease, Infantile spasms, Inflammatory myopathy, Intracranial cyst, Intracranial hypertension, Joubert syndrome, Karak syndrome, Kearns-Sayre syndrome, Kennedy disease, Kinsbourne syndrome, Kleine-Levin Syndrome, Klippel Feil syndrome, Krabbe disease, Kugelberg-Welander disease, Lafora disease, Lambert-Eaton myasthenic syndrome, Landau-Kleffner syndrome, Lateral medullary (Wallenberg) syndrome, Learning disabilities, Leigh's disease, Lennox-Gastaut syndrome, Lesch-Nyhan syndrome, Leukodystrophy, Lewy body dementia, Lissencephaly, Locked-In syndrome, Lou Gehrig's disease (See amyotrophic lateral sclerosis), Lumbar disc disease, Lumbar spinal stenosis, Lyme disease—Neurological Sequelae, Machado-Joseph disease (Spinocerebellar ataxia type 3), Macrencephaly, Macropsia, Megalencephaly, Melkersson-Rosenthal syndrome, Menieres disease, Meningitis, Menkes disease, Metachromatic leukodystrophy, Microcephaly, Micropsia, Migraine, Miller Fisher syndrome, Mini-stroke (transient ischemic attack), Misophonia, Mitochondrial myopathy, Mobius syndrome, Monomelic amyotrophy, Motor Neurone Disease—see amyotrophic lateral sclerosis, Motor skills disorder, Moyamoya disease, Mucopolysaccharidoses, Multi-infarct dementia, Multifocal motor neuropathy, Multiple sclerosis, Multiple system atrophy, Muscular dystrophy, Myalgic encephalomyelitis, Myasthenia gravis, Myelinoclastic diffuse sclerosis, Myoclonic Encephalopathy of infants, Myoclonus, Myopathy, Myotubular myopathy, Myotonia congenital, Narcolepsy, Neuro-Behçet's disease, Neurofibromatosis, Neuroleptic malignant syndrome, Neurological manifestations of AIDS, Neurological sequelae of lupus, Neuromyotonia, Neuronal ceroid lipofuscinosis, Neuronal migration disorders, Neuropathy, Neurosis, Niemann-Pick disease, Non-24-hour sleep-wake disorder, Nonverbal learning disorder, O'Sullivan-McLeod syndrome, Occipital Neuralgia, Occult Spinal Dysraphism Sequence, Ohtahara syndrome, Olivopontocerebellar atrophy, Opsoclonus myoclonus syndrome, Optic neuritis, Orthostatic Hypotension, Otosclerosis, Overuse syndrome, Palinopsia, Paresthesia, Parkinson's disease, Paramyotonia Congenita, Paroxysmal attacks, Parry-Romberg syndrome, Pelizaeus-Merzbacher disease, Periodic Paralyses, Peripheral neuropathy, Pervasive developmental disorders, Photic sneeze reflex, Phytanic acid storage disease, Pick's disease, Pinched nerve, PMG, Polyneuropathy, Polio, Polymicrogyria, Polymyositis, Porencephaly, Post-Polio syndrome, Postherpetic Neuralgia (PHN), Postural Hypotension, Prader-Willi syndrome, Primary Lateral Sclerosis, Prion diseases, Progressive hemifacial atrophy, Progressive multifocal leukoencephalopathy, Progressive Supranuclear Palsy, Quadriplegia, Rabies, Ramsay Hunt syndrome type I, Ramsay Hunt syndrome type II, Ramsay Hunt syndrome type III, Rasmussen's encephalitis, Reflex neurovascular dystrophy, Refsum disease, Repetitive stress injury, Restless legs syndrome, Retrovirus-associated myelopathy, Rett syndrome, Reye's syndrome, Rhythmic Movement Disorder, Romberg syndrome, Saint Vitus dance, Sandhoff disease, Schizencephaly, Sensory processing disorder, Septo-optic dysplasia, Shaken baby syndrome, Shingles, Shy-Drager syndrome, Sjögren's syndrome, Sleep apnea, Sleeping sickness, Snatiation, Sotos syndrome, Spasticity, Spina bifida, Spinal cord injury, Spinal muscular atrophy, Spinocerebellar ataxia, Split-brain, Steele-Richardson-Olszewski syndrome, Stiff-person syndrome, Stroke, Sturge-Weber syndrome, Subacute sclerosing panencephalitis, Subcortical arteriosclerotic encephalopathy, Superficial siderosis, Sydenham's chorea, Syncope, Synesthesia, Syringomyelia, Tarsal tunnel syndrome, Tardive dyskinesia, Tardive dysphrenia, Tarlov cyst, Tay-Sachs disease, Temporal arteritis, Tetanus, Tethered spinal cord syndrome, Thomsen disease, Thoracic outlet syndrome, Tic Douloureux, Todd's paralysis, Tourette syndrome, Toxic encephalopathy, Transient ischemic attack, Transmissible spongiform encephalopathies, Transverse myelitis, Traumatic brain injury, Tremor, Trigeminal neuralgia, Tropical spastic paraparesis, Trypanosomiasis, Tuberous sclerosis, Ubisiosis, Von Hippel-Lindau disease (VHL), Viliuisk Encephalomyelitis (VE), Wallenberg's syndrome, Werdnig-Hoffman disease, West syndrome, Whiplash, Williams syndrome, Wilson's disease and Zellweger syndrome.

In one example, a GFR-binding compound, functionalised bioactive carrier, or pharmaceutical (therapeutic, dermatologic, ophthalmologic, diagnostic, etc.) composition, all as defined herein, may be a neuroregenerative or neurodegeneration regulator/modulator/inhibitor compound, bioactive carrier or composition which has demonstrated the ability to induce neuroregeneration and/or prevention, decrease or suppression of neuron degeneration in vitro and/or ex-vivo and/or in vivo.

In one aspect, the present disclosure thus provides:
  a method of inducing or promoting or enhancing mesenchymal stem cell, progenitor neuronal cell (at any stage of differentiation of the neuronal cell lineage) differentiation, the method comprising administering to the cell an effective amount of at least one (modified) GFR-binding compound, at least one functionalised bioactive carrier, or at least one pharmaceutical composition, all as defined herein;
  a method of inducing or promoting or enhancing or controlling or regulating neuron regeneration/formation, the method comprising administering to a mesenchymal stem cell or to a progenitor neuronal cell at any stage of differentiation of the neuronal cell lineage or to a mature neuron, an effective amount of at least one (modified) GFR-binding compound, at least one functionalised bioactive carrier, or at least one pharmaceutical composition, all as defined herein;
  a method of inducing and/or promoting and/or enhancing neuronal cell maturation, the method comprising administering to a differentiated neuronal cell or to a mature neuronal cell an effective amount of at least one (modified) GFR-binding compound, at least one functionalised bioactive carrier, or at least one pharmaceutical composition, all as defined herein;
  an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor neuronal cell (at any stage of differentiation of the neuronal cell lineage) differentiation;
  an effective amount of at least one (modified) GFR-binding compound, at least one functionalised bioactive carrier, or at least one pharmaceutical composition, all as defined herein for use in a method of inducing or promoting or enhancing or controlling or regulating neuron regeneration/formation;
  an effective amount of at least one (modified) GFR-binding compound, at least one functionalised bioactive carrier, or at least one pharmaceutical composition, all as defined herein for use in a method of inducing and/or promoting and/or enhancing neuronal cell maturation.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing/promoting eye retina cell regeneration and/or treating and/or preventing and/or decreasing or suppressing eye retina cell degeneration-related conditions or diseases.

Eye-related diseases or disorders in which the present invention may thus be useful include, but are not limited to, Focal chorioretinal inflammation Focal such chorioretinitis, choroiditis, retinitis and retinochoroiditis, Disseminated chorioretinal inflammation, Posterior cyclitis, Harada's disease, Chorioretinal scars such as Macula scars of posterior pole and Solar retinopathy, Choroidal degeneration such as Atrophy and Sclerosis, Hereditary choroidal dystrophy such as Choroideremia, Gyrate atrophy, Choroidal haemorrhage, Choroidal detachment, Chorioretinitis, Retinal detachment, Retinoschisis, Retinal vascular occlusions, Hypertensive retinopathy, Diabetic retinopathy, Retinopathy, Retinopathy of prematurity, Age-related macular degeneration, Macular degeneration, Epiretinal membrane, Peripheral retinal degeneration, Hereditary retinal dystrophy, Retinitis pigmentosa, Retinal haemorrhage, Central serous retinopathy, Retinal detachment and Macular edema.

In one example, a GFR-binding compound, functionalised bioactive carrier, or pharmaceutical (therapeutic, dermatologic, ophthalmologic, diagnostic, etc.) composition, all as defined herein, may be an eye tissue-regenerative or eye tissue-degeneration regulator/modulator/inhibitor compound, bioactive carrier or composition which has demonstrated the ability to induce eye retina cell regeneration and/or prevent and/or decrease or suppress eye retina cell degeneration in vitro and/or ex-vivo and/or in vivo.

In one aspect, the present disclosure thus provides:
- a method of inducing or promoting or enhancing mesenchymal stem cell, progenitor eye retina cell (at any stage of differentiation of the retinal cell lineage) differentiation, the method comprising administering to the cell an effective amount of at least one (modified) GFR-binding compound, at least one functionalised bioactive carrier, or at least one pharmaceutical composition, all as defined herein;
- a method of inducing or promoting or enhancing or controlling or regulating eye retina cell regeneration/formation, the method comprising administering to a mesenchymal stem cell or to a progenitor eye retina cell at any stage of differentiation of the retinal cell lineage or to a mature eye retina cell, an effective amount of at least one (modified) GFR-binding compound, at least one functionalised bioactive carrier, or at least one pharmaceutical composition, all as defined herein;
- a method of inducing and/or promoting and/or enhancing eye retina cell maturation, the method comprising administering to a differentiated eye retina cell or to a mature eye retina cell an effective amount of at least one (modified) GFR-binding compound, at least one functionalised bioactive carrier, or at least one pharmaceutical composition, all as defined herein;
- an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor eye retina cell (at any stage of differentiation of the retinal cell lineage) differentiation;
- an effective amount of at least one (modified) GFR-binding compound, at least one functionalised bioactive carrier, or at least one pharmaceutical composition, all as defined herein for use in a method of inducing or promoting or enhancing or controlling or regulating eye retina cell regeneration/formation;
- an effective amount of at least one (modified) GFR-binding compound, at least one functionalised bioactive carrier, or at least one pharmaceutical composition, all as defined herein for use in a method of inducing and/or promoting and/or enhancing eye retina cell maturation.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing/promoting renal functions such as enhancing/improving waste removal, body's fluid balance control and electrolytes balance control and/or preventing/treating kidneys failure and/or chronic kidney disease (CKD) and/or renal fibrosis.

In one example, a GFR-binding compound, functionalised bioactive carrier, or pharmaceutical (therapeutic, dermatologic, ophthalmologic, diagnostic, etc.) composition, all as defined herein, may be a kidneys-function enhancing compound, bioactive carrier or composition which has demonstrated the ability to promote/improve kidneys functions and/or preventing/treating kidneys failure and/or chronic kidney disease (CKD) and/or renal fibrosis in vitro and/or ex-vivo and/or in vivo.

In one aspect, the present disclosure thus provides:
- a method of inducing or promoting or enhancing mesenchymal stem cell, progenitor renal cell (at any stage of differentiation of the renal cell lineage) differentiation, the method comprising administering to the cell an effective amount of at least one (modified) GFR-binding compound, at least one functionalised bioactive carrier, or at least one pharmaceutical composition, all as defined herein;
- a method of inducing or promoting or enhancing or controlling or regulating renal cell regeneration/formation, the method comprising administering to a mesenchymal stem cell or to a progenitor renal cell at any stage of differentiation of the renal cell lineage or to a mature renal cell, an effective amount of at least one (modified) GFR-binding compound, at least one functionalised bioactive carrier, or at least one pharmaceutical composition, all as defined herein;
- a method of inducing and/or promoting and/or enhancing renal cell maturation, the method comprising administering to a differentiated renal cell or to a mature renal cell an effective amount of at least one (modified) GFR-binding compound, at least one functionalised bioactive carrier, or at least one pharmaceutical composition, all as defined herein;
- an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor renal cell (at any stage of differentiation of the renal cell lineage) differentiation;
- an effective amount of at least one (modified) GFR-binding compound, at least one functionalised bioactive carrier, or at least one pharmaceutical composition, all as defined herein for use in a method of inducing or promoting or enhancing or controlling or regulating renal cell regeneration/formation;
- an effective amount of at least one (modified) GFR-binding compound, at least one functionalised bioactive carrier, or at least one pharmaceutical composition, all as defined herein for use in a method of inducing and/or promoting and/or enhancing renal cell maturation.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing/promoting fibrous tissue formation and tendon and ligament regeneration and/or preventing and/or decreasing or suppressing tendon/ligament cell degeneration.

In one example, a GFR-binding compound, functionalised bioactive carrier, or pharmaceutical (therapeutic, dermatologic, ophthalmologic, diagnostic, etc.) composition, all as defined herein, may be a fibrous tissue formation promoting compound, bioactive carrier or composition which has demonstrated the ability to induce fibrous tissue formation in vitro and/or ex-vivo and/or in vivo.

In one aspect, the present disclosure thus provides:
- a method of inducing or promoting or enhancing mesenchymal stem cell, progenitor tendon/ligament cell (at any stage of differentiation of the T/L cell lineage) differentiation, the method comprising administering to the cell an effective amount of at least one (modified) GFR-binding compound, at least one functionalised bioactive carrier, or at least one pharmaceutical composition, all as defined herein;
- a method of inducing or promoting or enhancing or controlling or regulating tendon/ligament cell regeneration/formation, the method comprising administering to a mesenchymal stem cell or to a progenitor tendon/ligament cell at any stage of differentiation of the T/L cell lineage or to a mature tendon/ligament cell, an effective amount of at least one (modified) GFR-binding compound, at least one functionalised bioactive carrier, or at least one pharmaceutical composition, all as defined herein;
- a method of inducing and/or promoting and/or enhancing tendon/ligament cell maturation, the method comprising administering to a differentiated tendon/ligament cell or to a mature tendon/ligament cell an effective amount of at least one (modified) GFR-binding compound, at least one functionalised bioactive carrier, or at least one pharmaceutical composition, all as defined herein;
- an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor tendon/ligament cell (at any stage of differentiation of the T/L cell lineage) differentiation;
- an effective amount of at least one (modified) GFR-binding compound, at least one functionalised bioactive carrier, or at least one pharmaceutical composition, all as defined herein for use in a method of inducing or promoting or enhancing or controlling or regulating tendon/ligament cell regeneration/formation;
- an effective amount of at least one (modified) GFR-binding compound, at least one functionalised bioactive carrier, or at least one pharmaceutical composition, all as defined herein for use in a method of inducing and/or promoting and/or enhancing tendon/ligament cell maturation.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, hair follicle tissue regeneration and formation (hair growth), hair follicle stem cell activation (loss of quiescence state) and/or preventing/treating alopecia areata, alopecia totalis, alopecia universalis, androgenic alopecia (male pattern baldness), telogen effluvium, anagen effluvium or chemotherapy-induced alopecia.

In one example, a GFR-binding compound, functionalised bioactive carrier, or pharmaceutical (therapeutic, dermatologic, ophthalmologic, diagnostic, etc.) composition, all as defined herein, may be a hair follicle growth activation promoting compound, bioactive carrier or composition which has demonstrated the ability to induce hair follicle formation and/or hair follicle stem cell activation in vitro and/or ex-vivo and/or in vivo.

In one aspect, the present disclosure thus provides:
- a method of inducing or promoting or enhancing mesenchymal stem cell, progenitor hair follicle cell (at any stage of differentiation of the hair follicle cell lineage) differentiation, the method comprising administering to the cell an effective amount of at least one (modified) GFR-binding compound, at least one functionalised bioactive carrier, or at least one pharmaceutical composition, all as defined herein;
- a method of inducing or promoting or enhancing or controlling or regulating hair follicle cell regeneration/formation, the method comprising administering to a mesenchymal stem cell or to a progenitor hair follicle cell at any stage of differentiation of the hair follicle cell lineage or to a mature hair follicle cell, an effective amount of at least one (modified) GFR-binding compound, at least one functionalised bioactive carrier, or at least one pharmaceutical composition, all as defined herein;
- a method of inducing and/or promoting and/or enhancing hair follicle cell maturation, the method comprising administering to a differentiated hair follicle cell or to a mature hair follicle cell an effective amount of at least one (modified) GFR-binding compound, at least one functionalised bioactive carrier, or at least one pharmaceutical composition, all as defined herein;
- a method of activating hair follicle stem cells, the method comprising administering to a quiescent hair follicle stem cell an effective amount of at least one (modified) GFR-binding compound, at least one functionalised bioactive carrier, or at least one pharmaceutical composition, all as defined herein;
- an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor hair follicle cell (at any stage of differentiation of the hair follicle cell lineage) differentiation;
- an effective amount of at least one (modified) GFR-binding compound, at least one functionalised bioactive carrier, or at least one pharmaceutical composition, all as defined herein for use in a method of inducing or promoting or enhancing or controlling or regulating hair follicle cell regeneration/formation;
- an effective amount of at least one (modified) GFR-binding compound, at least one functionalised bioactive carrier, or at least one pharmaceutical composition, all as defined herein for use in a method of inducing and/or promoting and/or enhancing tendon/ligament cell maturation;
- an effective amount of at least one (modified) GFR-binding compound, at least one functionalised bioactive carrier, or at least one pharmaceutical composition, all as defined herein for use in a method of activating hair follicle stem cells.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing tissue closure.

In one example, a GFR-binding compound, functionalised bioactive carrier, or pharmaceutical (therapeutic, dermatologic, ophthalmologic, diagnostic, etc.) composition, all as defined herein, may be a tissue-closure-promoting compound or biomaterial which has demonstrated the ability to induce tissue closure in vitro and/or ex-vivo and/or in vivo.

In one aspect, the present disclosure thus provides:
a method of inducing or promoting or enhancing tissue closure, the method comprising administering to an incised/opened tissue an effective amount of at least one (modified) GFR-binding compound, at least one functionalised bioactive carrier, or at least one pharmaceutical composition, all as defined herein;
an effective amount of at least one (modified) GFR-binding compound, at least one functionalised bioactive carrier, or at least one pharmaceutical composition, all as defined herein for use in a method of inducing or promoting or enhancing tissue closure.

In particular, medical applications which may result from the mediation of type I and II growth factor receptors by a GFR-binding compound, functionalised bioactive carrier, or pharmaceutical (therapeutic, dermatologic, ophthalmologic, diagnostic, etc.) composition, all as defined herein, include, but are not limited to, enhancing/promoting female fertility and/or preventing and/or decreasing or suppressing female infertility.

In one example, a GFR-binding compound, functionalised bioactive carrier, or pharmaceutical (therapeutic, dermatologic, ophthalmologic, diagnostic, etc.) composition, all as defined herein, may be a female fertility enhancing or a female infertility regulator/modulator/inhibitor compound, bioactive carrier or composition which has demonstrated the ability to enhance/promote female fertility and/or prevent and/or decrease or suppress female infertility in vitro and/or ex-vivo and/or in vivo.

In one aspect, the present disclosure thus provides:
a method of inducing or promoting or enhancing mesenchymal stem cell, progenitor ovarian cell (at any stage of differentiation of the reproduction system lineage) differentiation, the method comprising administering to the cell an effective amount of at least one (modified) GFR-binding compound, at least one functionalised bioactive carrier, or at least one pharmaceutical composition, all as defined herein;
a method of inducing or promoting or enhancing or controlling or regulating ovarian cell regeneration/formation, the method comprising administering to a mesenchymal stem cell or to a progenitor ovarian cell at any stage of differentiation of the reproduction system lineage or to a mature ovarian cell, an effective amount of at least one (modified) GFR-binding compound, at least one functionalised bioactive carrier, or at least one pharmaceutical composition, all as defined herein;
a method of inducing and/or promoting and/or enhancing ovarian cell maturation, the method comprising administering to a differentiated ovarian cell or to a mature ovarian cell an effective amount of at least one (modified) GFR-binding compound, at least one functionalised bioactive carrier, or at least one pharmaceutical composition, all as defined herein;
an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor ovarian cell (at any stage of differentiation of the reproduction system lineage) differentiation;
an effective amount of at least one (modified) GFR-binding compound, at least one functionalised bioactive carrier, or at least one pharmaceutical composition, all as defined herein for use in a method of inducing or promoting or enhancing or controlling or regulating ovarian cell regeneration/formation;
an effective amount of at least one (modified) GFR-binding compound, at least one functionalised bioactive carrier, or at least one pharmaceutical composition, all as defined herein for use in a method of inducing and/or promoting and/or enhancing ovarian cell maturation.

In particular, medical applications which may result from the mediation of type I and II growth factor receptors by a (modified) GFR-binding compound, functionalised bioactive carrier, or pharmaceutical (therapeutic, dermatologic, ophthalmologic, diagnostic, etc.) composition, all as defined herein, include, but are not limited to, enhancing of myogenesis, inducing muscle tissue formation, reinforcing muscle tissues, inducing myocyte maturation, repairing damaged muscles, preventing muscle tissue degeneration or damages, and/or protecting a subject from one or more muscle tissue-related diseases, disorders, conditions or pathologies such as myopathies, muscular atrophy, disuse atrophy, denervation atrophy, muscular dystrophies such as the Duchenne muscular dystrophy (DMD), and the Becker muscular dystrophy (BMD), fibrosis, fibrositis, muscle weakness, fatigue, cramps, fibromyalgia, or chronic muscle pain syndrome.

In one example, a (modified) GFR-binding compound, functionalised bioactive carrier, or pharmaceutical (therapeutic, dermatologic, ophthalmologic, diagnostic, etc.) composition, all as defined herein, may thus be an myoinductive compound, bioactive carrier or composition which has demonstrated an ability to induce muscle tissue formation in vitro and/or ex-vivo and/or in vivo.

In one aspect, the present disclosure thus provides:
a method of inducing or promoting or enhancing mesenchymal stem cell, progenitor myoblast (at any stage of differentiation of the muscle cell lineage) differentiation, the method comprising administering to the cell an effective amount of at least one (modified) GFR-binding compound, at least one functionalised bioactive carrier, or at least one pharmaceutical composition, all as defined herein;
a method of inducing or promoting or enhancing or controlling or regulating muscle tissue regeneration/formation, the method comprising administering to a mesenchymal stem cell or to a progenitor myoblast at any stage of differentiation of the muscle cell lineage or to a mature myoblast, an effective amount of at least one (modified) GFR-binding compound, at least one functionalised bioactive carrier, or at least one pharmaceutical composition, all as defined herein;
a method of inducing and/or promoting and/or enhancing myocyte maturation, the method comprising administering to a differentiated myoblast or to a mature myoblast (e.g. an myocyte) an effective amount of at least one (modified) GFR-binding compound, at least one functionalised bioactive carrier, or at least one pharmaceutical composition, all as defined herein;

an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor myoblast (at any stage of differentiation of the muscle cell lineage) differentiation;

an effective amount of at least one (modified) GFR-binding compound, at least one functionalised bioactive carrier, or at least one pharmaceutical composition, all as defined herein for use in a method of inducing or promoting or enhancing or controlling or regulating muscle tissue regeneration/formation;

an effective amount of at least one (modified) GFR-binding compound, at least one functionalised bioactive carrier, or at least one pharmaceutical composition, all as defined herein for use in a method of inducing and/or promoting and/or enhancing myoblast maturation.

In particular, medical applications which may result from the mediation of type I and II growth factor receptors by a (modified) GFR-binding compound, functionalised bioactive carrier, or pharmaceutical (therapeutic, dermatologic, ophthalmologic, diagnostic, etc.) composition, all as defined herein, include, but are not limited to, enhancing blood tissue regeneration, inducing blood cell differentiation, or protecting a patient from a blood cell degeneration-related disease, condition, disorder, or pathology.

In one example, a (modified) GFR-binding compound, functionalised bioactive carrier, or pharmaceutical (therapeutic, dermatologic, ophthalmologic, diagnostic, etc.) composition, all as defined herein, may thus be a blood cell degeneration inhibitor, bioactive carrier or composition which has demonstrated an ability to induce blood cell formation in vitro and/or ex-vivo and/or in vivo.

In one aspect, the present disclosure thus provides:

a method of inducing or promoting or enhancing mesenchymal stem cell, progenitor blood cell (at any stage of differentiation of the Osteoblast cell lineage) differentiation, the method comprising administering to the cell an effective amount of at least one (modified) GFR-binding compound, at least one functionalised bioactive carrier, or at least one pharmaceutical composition, all as defined herein;

a method of inducing or promoting or enhancing or controlling or regulating blood cell regeneration/formation, the method comprising administering to a mesenchymal stem cell or to a progenitor blood cell at any stage of differentiation of the blood cell lineage or to a mature blood cell, an effective amount of at least one (modified) GFR-binding compound, at least one functionalised bioactive carrier, or at least one pharmaceutical composition, all as defined herein;

a method of inducing and/or promoting and/or enhancing blood cell maturation, the method comprising administering to a differentiated blood cell or to a mature blood cell (e.g. a mature red blood cell) an effective amount of at least one (modified) GFR-binding compound, at least one functionalised bioactive carrier, or at least one pharmaceutical composition, all as defined herein;

an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor blood cell (at any stage of differentiation of the blood cell lineage) differentiation;

an effective amount of at least one (modified) GFR-binding compound, at least one functionalised bioactive carrier, or at least one pharmaceutical composition, all as defined herein for use in a method of inducing or promoting or enhancing or controlling or regulating blood cell regeneration/formation;

an effective amount of at least one (modified) GFR-binding compound, at least one functionalised bioactive carrier, or at least one pharmaceutical composition, all as defined herein for use in a method of inducing and/or promoting and/or enhancing blood cell maturation.

In particular, medical applications which may result from the mediation of type I and II growth factor receptors by a (modified) GFR-binding compound, functionalised bioactive carrier, or pharmaceutical (therapeutic, dermatologic, ophthalmologic, diagnostic, etc.) composition, all as defined herein, include, but are not limited to, enhancing of lung tissue regeneration, inducing lung cell differentiation, or protecting a patient from a lung cell degeneration-related disease, condition, disorder, or pathology.

In one example, a (modified) GFR-binding compound, functionalised bioactive carrier, or pharmaceutical (therapeutic, dermatologic, ophthalmologic, diagnostic, etc.) composition, all as defined herein, may thus be a lung cell degeneration inhibitor, bioactive carrier or composition which has demonstrated an ability to induce lung cell formation in vitro and/or ex-vivo and/or in vivo.

In one aspect, the present disclosure thus provides:

a method of inducing or promoting or enhancing mesenchymal stem cell, progenitor lung cell (at any stage of differentiation of the Osteoblast cell lineage) differentiation, the method comprising administering to the cell an effective amount of at least one (modified) GFR-binding compound, at least one functionalised bioactive carrier, or at least one pharmaceutical composition, all as defined herein;

a method of inducing or promoting or enhancing or controlling or regulating lung cell regeneration/formation, the method comprising administering to a mesenchymal stem cell or to a progenitor lung cell at any stage of differentiation of the lung cell lineage or to a mature lung cell, an effective amount of at least one (modified) GFR-binding compound, at least one functionalised bioactive carrier, or at least one pharmaceutical composition, all as defined herein;

a method of inducing and/or promoting and/or enhancing lung cell maturation, the method comprising administering to a differentiated lung cell or to a mature lung cell an effective amount of at least one (modified) GFR-binding compound, at least one functionalised bioactive carrier, or at least one pharmaceutical composition, all as defined herein;

an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor lung cell (at any stage of differentiation of the lung cell lineage) differentiation;

an effective amount of at least one (modified) GFR-binding compound, at least one functionalised bioactive carrier, or at least one pharmaceutical composition, all as defined herein for use in a method of inducing or promoting or enhancing or controlling or regulating lung cell regeneration/formation;

an effective amount of at least one (modified) GFR-binding compound, at least one functionalised bioactive carrier, or at least one pharmaceutical composition, all as defined herein for use in a method of inducing and/or promoting and/or enhancing lung cell maturation.

In particular, medical applications which may result from the mediation of type I and II growth factor receptors by a (modified) GFR-binding compound, functionalised bioactive carrier, or pharmaceutical (therapeutic, dermatologic, ophthalmologic, diagnostic, etc.) composition, all as defined herein, include, but are not limited to, enhancing adipose tissue regeneration, inducing adipocyte differentiation, or protecting a patient from a adipose tissue degeneration-related disease, condition, disorder, or pathology.

In one example, a (modified) GFR-binding compound, functionalised bioactive carrier, or pharmaceutical (therapeutic, dermatologic, ophthalmologic, diagnostic, etc.) composition, all as defined herein, may thus be an adipose tissue degeneration inhibitor, bioactive carrier or composition which has demonstrated an ability to induce adipose tissue formation in vitro and/or ex-vivo and/or in vivo.

In one aspect, the present disclosure thus provides:
  a method of inducing or promoting or enhancing mesenchymal stem cell, progenitor adipocyte (at any stage of differentiation of the Osteoblast cell lineage) differentiation, the method comprising administering to the cell an effective amount of at least one (modified) GFR-binding compound, at least one functionalised bioactive carrier, or at least one pharmaceutical composition, all as defined herein;
  a method of inducing or promoting or enhancing or controlling or regulating adipose tissue regeneration/formation, the method comprising administering to a mesenchymal stem cell or to a progenitor adipocyte at any stage of differentiation of the adipocyte lineage or to a mature adipocyte, an effective amount of at least one (modified) GFR-binding compound, at least one functionalised bioactive carrier, or at least one pharmaceutical composition, all as defined herein;
  a method of inducing and/or promoting and/or enhancing adipocyte maturation, the method comprising administering to a differentiated adipocyte or to a mature adipocyte an effective amount of at least one (modified) GFR-binding compound, at least one functionalised bioactive carrier, or at least one pharmaceutical composition, all as defined herein;
  an effective amount of at least one (modified) GFR-binding compound, at least one functionalised bioactive carrier, or at least one pharmaceutical composition, all as defined herein for use in a method of inducing or promoting or enhancing mesenchymal stem cell or progenitor adipocyte (at any stage of differentiation of the adipocyte lineage) differentiation;
  an effective amount of at least one (modified) GFR-binding compound, at least one functionalised bioactive carrier, or at least one pharmaceutical composition, all as defined herein for use in a method of inducing or promoting or enhancing or controlling or regulating adipose tissue regeneration/formation;
  an effective amount of at least one (modified) GFR-binding compound, at least one functionalised bioactive carrier, or at least one pharmaceutical composition, all as defined herein for use in a method of inducing and/or promoting and/or enhancing adipocyte maturation.

Protected from a disease, condition, disorder or pathology refers to the treatment of the underlying cause of the disease, condition, disorder or pathology as well as reducing the symptoms of the disease, condition, disorder or pathology; and/or reducing the occurrence of the disease, condition, disorder or pathology; and/or reducing the severity of the disease, condition, disorder or pathology. Protecting a patient can refer to the ability of a therapeutic composition of the present invention, when administered to a patient, to prevent a disease, condition, disorder or pathology from occurring and/or to cure or to alleviate disease, condition, disorder or pathology symptoms, signs or causes. As such, to protect a patient from a disease, condition, disorder or pathology includes both preventing disease, condition, disorder or pathology occurrence (prophylactic treatment) and treating a patient that has a disease, condition, disorder or pathology or that is experiencing initial symptoms or later stage symptoms of a disease, condition, disorder or pathology (therapeutic treatment).

Treating: As used herein, unless indicated otherwise or contradictory in context, the term "treating" or "treatment" refers to partially or completely alleviating, ameliorating, improving, relieving, delaying onset of, inhibiting progression of, reducing severity of, and/or reducing incidence of one or more symptoms or features of a particular disease, disorder, pathology and/or condition. Treatment may be administered to a subject who does not exhibit signs of a disease, disorder, and/or condition and/or to a subject who exhibits only early signs of a disease, disorder, pathology and/or condition for the purpose of decreasing the risk of developing pathology associated with the disease, disorder, and/or condition.

Preventing: As used herein, unless indicated otherwise or contradictory in context, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Disease: As used herein, unless indicated otherwise or contradictory in context, the term "disease" refers to any deviation from the normal health of a patient and includes a state when disease symptoms are present, as well as conditions in which a deviation has occurred, but symptoms are not yet manifested. The same applies to "condition", "disorder" and "pathology".

In one aspect, the present disclosure provides methods of determining the effectiveness of a (modified) GFR-binding compound, a functionalised bioactive carrier or a pharmaceutical composition as defined herein for inducing cell differentiation, or inducing, promoting, enhancing, controlling or regulating tissue regeneration/formation in-vitro, ex-vivo and in-vivo comprising the administration of said (modified) GFR-binding compound, a functionalised bioactive carrier or a pharmaceutical composition to a cell; the measurement of the expression of specific differentiation markers as defined herein in the cell; the comparison of the expression of said specific differentiation markers in the cell to the expression of said specific differentiation markers in a cell treated with a reference (or control) functionalised bioactive carrier, compound or solvent; and determining the effectiveness of the (modified) GFR-binding compound, a functionalised bioactive carrier or a pharmaceutical composition relative to the reference pharmaceutical association or compound.

In one aspect, the present disclosure provides methods to activate, promote, support, improve, or increase the activity of a growth factor receptor present in, on the surface of a mesenchymal stem cell or progenitor cell (at any stage of differentiation thereof) such that said cell may undergo efficient cell differentiation.

In one aspect, the present disclosure provides methods of identifying, diagnosing, and optionally classifying subjects on these bases, which may include clinical diagnosis, biomarker levels, and other methods known in the art.

XVII. Wound Healing Applications

Specific applications of the invention in dermatology relate to wound healing and skin repair.

Thus, dermatological applications which may result from the mediation of type I and II growth factor receptors by a compound, functionalised bioactive carrier, or composition of the invention include, but are not limited to, enhancing wound healing, skin repair and cellular migration.

Skin repair: In the present description and unless otherwise indicated, the term "skin repair" means dermal and epidermal cells regeneration, collagen and other skin protein synthesis by epithelial cells.

Cellular migration: In the present description and unless otherwise indicated, the term "cellular migration" means a central process in the development and maintenance of multicellular organisms. Tissue formation during embryonic development, wound healing and immune responses all require the orchestrated movement of cells in particular directions to specific locations. The cells involved in cellular migration include the cells of the epithelial and dermal cell lineages forming the connective tissue i.e. the fibroblasts, fibrocytes, myofibroblasts, adipocytes, synoviocytes, macrophages, histiocytes, granulocytes, plasmocytes and mastocytes.

In one example, a (modified) GFR-binding compound, functionalised bioactive carrier, or pharmaceutical (therapeutic, dermatologic, ophthalmologic, diagnostic, etc.) composition, all as defined herein, may be a wound-healing-promoting compound, bioactive carrier, or composition which has demonstrated the ability to induce wound healing, skin repair and/or cellular migration in vitro, ex-vivo and/or in vivo.

In one aspect, the present disclosure thus provides:
- a method of inducing or promoting or enhancing mesenchymal stem cell, progenitor epithelial cell (at any stage of differentiation of the epithelial and dermal cell lineage) differentiation, the method comprising administering to the cell an effective amount of at least one (modified) GFR-binding compound, at least one functionalised bioactive carrier, or at least one pharmaceutical composition of the invention;
- a method of inducing or promoting or enhancing or controlling or regulating skin tissue regeneration/formation and/or tubular formation, the method comprising administering to a mesenchymal stem cell or to a progenitor epithelial cell at any stage of differentiation of the epithelial and dermal cell lineage or to a mature epithelial cell, an effective amount of at least one (modified) GFR-binding compound, at least one functionalised bioactive carrier, or at least one pharmaceutical composition of the invention;
- a method of inducing and/or promoting and/or enhancing cell motility or single/collective epithelial cell migration, the method comprising administering to a mesenchymal stem cell or to a progenitor epithelial cell at any stage of differentiation of the epithelial and dermal cell lineage or to a mature epithelial cell an effective amount of at least one (modified) GFR-binding compound, at least one functionalised bioactive carrier, or at least one pharmaceutical composition of the invention;
- a method of inducing and/or promoting and/or enhancing epithelial cell maturation, the method comprising administering to a differentiated epithelial cell or to a mature epithelial cell an effective amount of at least one (modified) GFR-binding compound, at least one functionalised bioactive carrier, or at least one pharmaceutical composition of the invention;
- an effective amount of at least one (modified) GFR-binding compound, at least one functionalised bioactive carrier, or at least one pharmaceutical composition of the invention for use in a method of inducing or promoting or enhancing mesenchymal stem cell, progenitor epithelial cell (at any stage of differentiation of the epithelial and dermal cell lineage) differentiation;
- an effective amount of at least one (modified) GFR-binding compound, at least one functionalised bioactive carrier, or at least one pharmaceutical composition of the invention for use in a method of inducing or promoting or enhancing or controlling or regulating skin tissue regeneration/formation;
- an effective amount of at least one (modified) GFR-binding compound, at least one functionalised bioactive carrier, or at least one pharmaceutical composition of the invention for use in a method of inducing and/or promoting and/or enhancing cell motility or single/collective epithelial cell migration,
- an effective amount of at least one (modified) GFR-binding compound, at least one functionalised bioactive carrier, or at least one pharmaceutical composition of the invention for use in a method of inducing and/or promoting and/or enhancing epithelial cell maturation.

XVIII. Cosmetic Applications

Skin ageing is typically associated with a deregulation of the metabolism of cutaneous cells characterized by a diminishing of the proliferation of keratinocytes, a deregulation of the differentiation of keratinocytes, an accumulation of dead cells, and a diminishing of the innervation of the skin.

Cosmetic, non-therapeutic, applications which may result from the mediation of type I and II growth factor receptors by a GFR-binding compound, functionalised bioactive carrier, or compositions thereof, all as defined herein, include, but are not limited to, enhancing/promoting skin regeneration, preventing and/or attenuating and/or masking and/or removing wrinkles, firming the skin, preventing and/or decreasing or suppressing skin pigmentation.

In one example, a GFR-binding compound, functionalised bioactive carrier, or compositions thereof, all as defined herein, may be an anti-wrinkle/ageing and/or skin-firming and/or skin regeneration-promoting compound, bioactive carrier or composition which has demonstrated the ability to enhance/promote skin cosmetic regeneration, prevent and/or attenuate and/or mask and/or remove wrinkles, firm the skin, prevent and/or decrease or suppress skin pigmentation in vitro and/or in vivo.

In one aspect, the present disclosure provides a cosmetic or functional food composition comprising at least one GFR-binding compound or at least one functionalised bioactive carrier, all as defined herein, in combination with at least one suitable cosmetic carrier, preferably suitable for topical application.

Suitable cosmetic carrier: The terms "suitable cosmetic carrier" used here, mean that the composition or the components of the latter are suitable for use in contact with human skin without undue toxicity, incompatibility, instability, allergic response or their equivalents.

In one aspect, the present disclosure provides a use of a GFR-binding compound, or functionalised bioactive carrier, all as defined herein, in cosmetics or as a functional food.

In one aspect, the present disclosure provides a use of a GFR-binding compound, functionalised bioactive carrier, or composition thereof, all as defined herein, or a cosmetic or functional food composition as defined herein as an anti-wrinkle/ageing agent. For example, in certain embodiments, the GFR-binding compound, functionalised bioactive carrier, or composition thereof, all as defined herein, is used as active ingredient to prevent or treat skin-ageing in a cosmetic composition or a functional food composition.

In one aspect, the present disclosure provides a use of a GFR-binding compound or functionalised bioactive carrier, all as defined herein, or a cosmetic composition thereof as defined herein in a method of cosmetic care, wherein said method of cosmetic care comprises the administration or the application of between about 0.0001 □g/day to about 5000 mg/day, between about 0.0001 □g/day to about 1000 mg/day, between about 0.0001 □g/day to about 10 mg/day, between about 0.0001 □g/day to about 1 mg/day, or between about 0.0001 □g/day to about 100 □g/day of said compound, bioactive carrier or composition, all being preferred and specifically contemplated for implementing embodiments of the invention.

In one example, the administration comprises the oral administration of a tablet, capsule, pill, powder, sustained release formulations, solution or suspension containing said GFR-binding compound or functionalised bioactive carrier, all as defined herein, or cosmetic or functional food compositions thereof as defined herein.

In one preferred example, said use comprises the topical application of a GFR-binding compound or functionalised bioactive carrier, all as defined herein, or cosmetic composition thereof as defined herein.

Suitable formulations for use in cosmetic care treatment include, for instance, the ones described in U.S. Pat. No. 8,497,241 B2, which is hereby incorporated by reference.

In one example, said cosmetic use of the invention is a non-therapeutic cosmetic use.

In one aspect, the present disclosure provides a cosmetic care or treatment method in which the GFR-binding compound, the functionalised bioactive carrier, or the cosmetic composition, all as defined herein, is used via topical application to stimulate the proliferation and/or activity of the fibroblasts.

For example, in certain embodiments, said cosmetic care method of the invention include treatment of skin ageing, especially unesthetic and/or uncomfortable manifestations of skin ageing, such as slackness of the tissues, loss of firmness of the tissues, the appearance of wrinkles, fine lines, and grooves, and/or for the cosmetic treatment and/or care of stretch marks and/or scars.

In one example, the cosmetic care method of the invention is preferably for protecting the skin against skin ageing.

Topical application: In the present description and unless otherwise indicated, the term "topical application" means to apply or spray the composition of the present invention onto the surface of the skin.

Cosmetic compositions of the invention may comprise other active agents of cosmetic interest especially the conventional agents for anti-ageing compositions especially those chosen from hyaluronic acid, ascorbic acid, retinol, alpha-hydroxy acids (AHAs) and/or ursolic acid.

In one example, the cosmetic composition of the invention may contain at least one of the following agents:
- an agent that stimulates the fibronectin synthesis, in particular a maize extract;
- an agent that stimulates the laminin synthesis, in particular an extract of malt;
- an agent that stimulates the expression and/or the activity of hyaluronan synthase 2 (HAS2);
- an agent that stimulates the synthesis of lysyl oxidase-like (LOXL);
- an agent that stimulates the synthesis of intracellular ATP;
- an agent that protects the degradation of FGF2.

GFR-binding compounds, or functionalised bioactive carrier in their cosmetic applications, optionally in the form of cosmetic compositions, are particularly suitable for protecting the skin against skin ageing that is natural and/or caused by climatic and environmental factors, especially the wind, pollution, UV rays, cigarette smoke and/or physiological factors, especially stress.

In one aspect, the present disclosure provides a cosmetic care or treatment method, for a subject having need thereof, said method comprising the application, preferably topical application, or administration of a cosmetic composition as defined herein.

In one example, the subject who has need of the cosmetic care of the invention is a subject chosen from a population having an average age of more than 30 years old, preferably of more than 40 years old, more preferably of more than 50 years old.

XIX. Hair Treatment Applications

Hair is subjected to a wide variety of severe stress, for example as a result of environmental influences, such as UV irradiation or weathering, mechanical stresses, such as combing, or various hair treatments, such as washing, drying with hot air, bleaching, coloring, perming, etc., which can lead to hair damage. Said damage includes e.g. dryness, reduced elasticity, brittleness, split ends, dullness, matt appearance, reduced fullness, rough surface and reduced mechanical strength. This leads to impaired combability, reduced shine, increased electrostatic charging, tendency to break and may go as far as hair loss in some cases. The hair wearer feels uneasy. Hair loss may be due to aging as through time, hair naturally tends to gradually thin. Other causes of hair loss include hormonal factors, medical conditions and medications. The most common cause of hair loss is a hereditary condition called male-pattern baldness or female-pattern baldness. In genetically susceptible people, certain sex hormones trigger a particular pattern of permanent hair loss. Most common in men, this type of hair thinning can begin as early as puberty. Hormonal changes and imbalances can also cause temporary hair loss. This could be due to pregnancy, childbirth, discontinuation of birth control pills or the onset of menopause. A variety of medical conditions may also cause hair loss, including, but not limited to, thyroid problems, alopecia areata, and scalp infections. Hair loss may further be caused by drugs used to treat Arthritis, depression, heart problems, high blood pressure, etc.

Medical or cosmetic applications which may result from the mediation of type I and II growth factor receptors by a (modified) GFR-binding compound, functionalised bioactive carrier or composition of the invention also include enhancing/promoting hair growth and/or preventing and/or decreasing or suppressing hair loss. Without wishing to be bound to any specific theories, this effect is thought to be achieved through activation of dormant (or quiescent) hair follicle stem cells by displacement of natural binding ligands such as BMP-6, strongly bound to their growth factor receptors.

In one example, a (modified) GFR-binding compound, or functionalised bioactive carrier as defined herein may be a hair growth-promoting or a hair loss-regulator/modulator/inhibitor compound or functionalised bioactive carrier which has demonstrated the ability to enhance/promote hair growth and/or prevent and/or decrease or suppress hair loss in vitro, ex-vivo and/or in vivo.

In one aspect, the present disclosure provides a hair cosmetic or functional food composition comprising at least one (modified) GFR-binding compound, or at least one functionalised bioactive carrier, all as defined herein, in combination with at least one suitable hair-cosmetic carrier, preferably suitable for topical application.

Topical applications may be performed by any end-user by, for instance, applying and optionally rubbing the hair scalp with a hair cosmetic composition of the invention e.g. formulated as a shampoo or conditioner.

In one aspect, the present disclosure provides a hair medical (pharmaceutical, prophylactic, diagnostic, imaging, etc.) composition comprising at least one (modified) GFR-binding compound, or at least one functionalised bioactive carrier, all as defined herein, in combination with at least one suitable hair-medical carrier, preferably suitable for scalp injection application.

Scalp injection applications may preferably be performed by experienced end-users such as dermatologists and/or surgeons, preferably in clinical/medical settings in clean or sterile environment. Several subcutaneous injections may be carried out under the scalp where needed and renewed every few weeks, preferably months if required.

In one aspect, the present invention discloses a use of a (modified) GFR-binding compound, or a functionalised bioactive carrier as defined herein, in hair cosmetics or as a functional food. In one aspect, the present invention discloses a (modified) GFR-binding compound, or a functionalised bioactive carrier as defined herein, for use in a hair medical method.

In one aspect, the present disclosure provides a use of a (modified) GFR-binding compound, a functionalised bioactive carrier, or a hair cosmetic or functional food composition, all as defined herein, as a hair growth-promoting agent or hair-loss-preventing agent. For example, in certain embodiments, the (modified) GFR-binding compound, or functionalised bioactive carrier as defined herein, is used as active ingredient to promote (enhance, regulate, modulate, improve) hair growth and/or prevent or treat hair-loss and/or embellish hair in a hair cosmetic composition or a functional food composition. In one aspect, the present disclosure provides a (modified) GFR-binding compound, a functionalised bioactive carrier, or a hair medical composition, all as defined herein, as a hair growth-promoting agent or hair-loss-preventing agent. For example, in certain embodiments, the (modified) GFR-binding compound, or functionalised bioactive carrier as defined herein, is used as active ingredient to promote (enhance, regulate, modulate, improve) hair growth and/or prevent or treat hair-loss and/or embellish hair in a hair medical composition.

In one aspect, the present disclosure provides a use of a (modified) GFR-binding compound, a functionalised bioactive carrier, or a hair cosmetic composition, all as defined herein, in a method of hair cosmetic care, wherein said method of hair cosmetic care comprises the administration or the application of between about 0.0001 to about 100 □g per day, more specifically between about 0.001 to about 10 □g per day or between about 0.0001 to about 100 □g per day of said compound, bioactive carrier or composition.

In one example, a (modified) GFR-binding compound, functionalised bioactive carrier, or hair-cosmetic composition, all as defined herein, may be combined/mixed with mesenchymal stem cells and/or follicle progenitor cells prior to be administered to, contacted with, or implanted into a mammal (preferably a human) to promote hair growth and/or prevent and/or decrease or suppress hair-loss.

In one example, the administration comprises the oral administration of a tablet, capsule, pill, powder, sustained release formulations, solution or suspension containing said (modified) GFR-binding compound, functionalised bioactive carrier, or hair-cosmetic composition, all as defined herein.

Suitable as forms of hair cosmetic compositions for implementing embodiments of the invention include hair rinse, hair mask, shampoo, conditioner, hair spray, hair foam, hair mousse, hair gel, hair tonic, hair setting composition, end fluid, neutralizer for permanent waves, hair colorant and bleach or hot-oil treatment.

Suitable formulations for use in hair treatment include, for instance, the ones described in US patent application No. 2011/0312884 A1, which is hereby incorporated by reference.

In one example, said hair cosmetic use of the invention is a non-therapeutic hair cosmetic use.

Hair cosmetic compositions of the invention may comprise at least one other active agent of hair cosmetic interest especially the conventional agents for hair treatment compositions especially at least one of the following agents:

anionic surfactants such as soaps, alkylsulfonates, alkylbenzenesulfonates, olefinsulfonates, alkyl ether sulfonates, glycerol ether sulfonates, methyl ester sulfonates, sulfo fatty acids, alkyl sulfates, fatty alcohol ether sulfates, glycerol ether sulfates, fatty acid ether sulfates, hydroxyl mixed ether sulfates, monoglyceride (ether) sulfates, fatty acid amide (ether) sulfates, mono- and dialkyl sulfosuccinates, mono- and dialkyl sulfosuccinamates, sulfotriglycerides, amide soaps, ethercarboxylic acids and salts thereof, fatty acid isethionates, fatty acid sarcosinates, fatty acid taurides, N-acylaminoacids, such as, for example, acyl lactylates, acyl tartrates, acyl glutamates and acyl aspartates, alkyl oligoglucosidesulfat. Suitable soaps are e.g. alkali metal, alkaline earth metal and ammonium salts of fatty acids, such as potassium stearate. Suitable olefinsulfonates may be present as alkali metal, alkaline earth metal, ammonium, alkylammonium, alkanolammonium or glucammonium salts. Preferably, the olefinsulfonates are present as sodium salts. The hydrolyzed alpha-olefinsulfonation product, i.e. the alpha-olefinsulfonates, are composed of ca. 60% by weight of alkanesulfonates and ca. 40% by weight of hydroxyalkanesulfonates; of these, about 80 to 85% by weight are monosulfonates and 15 to 20% by weight are disulfonates. Preferred methyl ester sulfonates (MES) are obtained by sulfonation of the fatty acid methyl esters of plant or animal fats or oils. Preference is given to methyl ester sulfonates from plant fats and oils, e.g. from rapeseed oil, sunflower oil, soya oil, palm oil, coconut fat, etc. Preferred sarcosinates are sodium lauroyl sarcosinate or sodium stearoyl sarcosinate. Preferred protein fatty acid condensates are plant products based on wheat. Preferred alkyl phosphates are mono- and diphosphoric acid alkyl esters.

Fatty alcohols having preferably 8 to 30 carbon atoms, particularly preferably 10 to 22 carbon atoms, in particular 12 to 20 carbon atoms. The hydrocarbon radical of the fatty alcohols can in principle be linear or branched, saturated or unsaturated. Typical examples of fatty alcohols are caproic alcohol, caprylic alcohol, 2-ethylhexyl alcohol, capric alcohol, lauryl alcohol, isotridecyl alcohol, myristyl alcohol, cetyl alcohol, palmoleyl alcohol, stearyl alcohol, isostearyl alcohol, oleyl alcohol, elaidyl alcohol, petroselinyl alcohol, linolyl alcohol, linolenyl alcohol, elaeostearyl alcohol and mixtures thereof. Preferred mixtures of the fatty alcohols are based on technical-grade alcohol mixtures which are produced e.g. during the high-pressure hydrogenation of technical-grade methyl esters based on fats and oils or during the hydrogenation of aldehydes from the oxo synthesis or during the dimerization of unsaturated fatty alcohols.

phospholipids, nonionic surfactants, amphoteric surfactants, cationic surfactants and mixtures thereof. Phospholipids are phosphorus-containing amphiphilic lipids such as phosphatidylserines, sphingomyelins and plasmalogens. Also suitable are the so-called lysophospholipids in which a fatty acid radical has been separated off from the phospholipid molecule to give an OH group, e.g. with the help of a phospholipase. The nonionic surfactants include, for example: fatty alcohol polyoxyalkylene esters, for example lauryl alcohol polyoxyethylene acetate, alkyl polyoxyalkylene ethers which are derived from low molecular weight C1-C6-alkohols or from C7-C30-fatty alcohols. Here, the ether component can be derived from ethylene oxide units, propylene oxide units, 1,2-butylene oxide units, 1,4-butylene oxide units and random copolymers and block copolymers thereof. These include specifically fatty alcohol alkoxylates and oxo alcohol alkoxylates such as isotridecyl alcohol and oleyl alcohol polyoxyethylene ethers, alkylaryl alcohol polyoxyethylene ethers, e.g. octylphenol polyoxyethylene ethers, alkoxylated animal and/or plant fats and/or oils, for example corn oil ethoxylates, castor oil ethoxylates, tallow fat ethoxylates, glycerol esters, such as, for example, glycerol monostearate, alkylphenol alkoxylates, such as, for example, ethoxylated isooctyl-, octyl- or nonylphenol, tributylphenol polyoxyethylene ether, fatty amine alkoxylates, fatty acid amide and fatty acid diethanolamide alkoxylates, in particular ethoxylates thereof, sugar surfactants, sorbitol esters, such as, for example, sorbitan fatty acid esters (sorbitan monooleate, sorbitan tristearate), polyoxyethylene sorbitan fatty acid esters, alkyl polyglycosides, N-alkylgluconamides, alkyl methyl sulfoxides, alkyl dimethyl phosphine oxides, such as, for example, tetradecyl dimethyl phosphine oxide. Suitable amphoteric surfactants are e.g. alkylbetaines, alkylamidopropylbetaines, alkylsulfobetaines, alkyl glycinates, alkyl carboxyglycinates, alkyl amphoacetates or propionates, alkyl amphodiacetates or dipropionates. For example, it is possible to use cocodimethylsulfopropylbetaine, laurylbetaine, cocamidopropylbetaine, sodium cocamphopropionate or tetradecyldimethylamine oxide. The cationic surfactants include, for example, quaternized ammonium compounds, in particular alkyltrimethylammonium and dialkyldimethylammonium halides and alkyl sulfates, and pyridine and imidazoline derivatives, in particular alkylpyridinium halides. For example, behenyl or cetyltrimethylammonium chloride may suitably be used.

an antidandruff active ingredient. Suitable antidandruff active ingredients are piroctone olamine (1-hydroxy-4-methyl-6-(2,4,4-trimethylpentyl)-2-(1H)-pyridinonemonoethanolamine salt), crinipan AD (climbazole), ketoconazole, elubiol, selenium disulfide, sulfur colloidal, sulfur polyethylene glycol sorbitan monooleate, sulfur ricinol polyethoxylate, sulfur tar distillates, salicylic acid (or in combination with hexachlorophene), undecylenic acid monoethanolamide sulfosuccinate Na salt, lamepon UD (protein-undecylenic acid condensate), zinc pyrithione, aluminum pyrithione and magnesium pyrithione/dipyrithione magnesium sulfate.

proteins and protein derivatives, cosmetically active polymers, hair pigmentation agents, bleaches, keratin-hardening substances, antimicrobial active ingredients, light filter active ingredients, repellent active ingredients, hyperemic substances, antiphlogistics, keratinizing substances, antioxidative active ingredient and/or free radical active ingredients, sebostatic active ingredients, plant extracts, antierythematous or antiallergic active ingredients and mixtures thereof.

a cosmetically acceptable auxiliary such as oil bodies, fats, waxes, pearlescent waxes, propellants, consistency regulators, thickeners, superfatting agents, stabilizers, polymers, silicone compounds, UV stabilizers, antioxidants, film formers, swelling agents, hydrotropes, solubilizers, preservatives, perfume oils, dyes, etc. and mixtures thereof.

In one aspect, the invention discloses a hair cosmetic care or treatment method, for a subject having need thereof, said method comprising the application, preferably topical or scalp injection applications, or administration of a hair cosmetic composition according to the present invention.

In one aspect, the present invention discloses a hair cosmetic care or treatment method in which the (modified) GFR-binding compound, functionalised bioactive carrier, or hair cosmetic composition, all as defined herein, is used to stimulate/activate hair follicle stem cells.

In one example, the subject who has need of the hair cosmetic care of the invention is a subject chosen from a population having an average age of more than 30 years old, preferably of more than 40 years old, more preferably of more than 50 years old.

XX. Diagnostic Methods

In one aspect, the present disclosure provides a (modified) GFR-binding compound, a functionalised bioactive carrier or a medical or cosmetic composition as defined herein for use in a diagnostic method of a disease or condition which may require mesenchymal stem cells or progenitor cells (at any stage of differentiation thereof) to be differentiated.

In one aspect, the present disclosure provides a diagnostic method for diagnosing of a disease or condition which may require mesenchymal stem cells or progenitor cells (at any stage of differentiation thereof) to be differentiated comprising the provision of a (modified) GFR-binding compound or a pharmaceutical association, combination or composition as defined herein, and the contacting or administration of said GFR-binding compound or pharmaceutical association, combination or composition with a body part of a subject to be diagnosed.

A method for the diagnosis of a disease or condition which may require mesenchymal stem cells or progenitor cells (at any stage of differentiation thereof) to be differentiated in a patient, comprising obtaining a biological sample from a patient and apply fluorescent and/or radiolabeled (modified) GFR binding compounds, wherein high localisation of these compounds indicates a disease or condition which may require mesenchymal stem cells or progenitor cells (at any stage of differentiation thereof) to be differentiated in the patient.

XXI. Screening Methods

In one aspect, the present disclosure provides a screening method for selecting a peptide or a peptidomimetic having the ability to induce tissue regeneration and cell differentiation.

In one aspect, the present disclosure provides a screening method for selecting a peptide or peptidomimetic having the ability to induce tissue regeneration and cell differentiation, the method comprising the steps of (a) providing a molecular model of the following 3D structure coordinates of PEPREF and (b) identifying a candidate analog having a RMSD value of 2.45 Å or less. In particular example, step (b) is performed using the method of RMSD calculation as already defined herein In certain embodiments, the method can be performed using a computer (i.e., in silico). In some embodiments, the method can include providing the three-dimensional models of a plurality of peptides or peptidomimetics (i.e., a library or database of peptides or peptidomimetics) and screening each compound individually. Thus, in one aspect, the method of screening peptides or peptidomimetics generally includes computationally evaluating the potential of a selected peptide(s) or peptidomimetic(s) to structurally match with the computational model of the three-dimensional structure of PEPREF. For example, this method can include the steps of (a) employing a computational approach to perform a fitting operation between the selected peptide(s) or peptidomimetic(s) and the three-dimensional structure of PEPREF; and (b) analysing the results of the fitting operation to quantify the three-dimensional structural similarities between the peptide(s) or peptidomimetic(s) and PEPREF using the RMSD procedure as defined herein.

In one aspect, the present disclosure provides a method of producing a peptide or peptidomimetic having the ability to induce tissue regeneration and cell differentiation, the method comprising the steps of (a) providing a molecular model of the following 3D structure coordinates of PEPREF; b) identifying a candidate analog having a RMSD as defined herein of 2.45 Å or less (in particular 2, more particularly 1.79); and (c) producing the candidate analog identified in step (b). In one particular example, said method further comprising the step of determining whether the compound produced in step (c) has a cell differentiation and tissue regeneration activity. In one particular example, steps (a) and (b) are performed by means of an electronic processor. In certain embodiments, step (a) comprises storing a representation of the atomic co-ordinates of PEPREF in a computer memory.

In one aspect, the present disclosure provides a method of producing a peptide or peptidomimetic having the ability to induce tissue regeneration and cell differentiation, the method comprising the steps of: (a) providing in a computer memory atomic X-ray crystallographic co-ordinates of PEPREF; (b) generating with a processor a molecular model having a three-dimensional shape of PEPREF; (c) identifying a candidate analog having a RMSD of 2.45 Å or less (in particular 2, more particularly 1.79); (d) producing the candidate analog identified in step (c); and (e) determining whether the candidate analog produced in step (d) induces tissue regeneration and cell differentiation. In one particular example, said method comprises the additional step of producing the peptide or peptidomimetic in a commercially useful quantity.

In one aspect, the present disclosure provides a computer system comprising: (a) a memory comprising atomic X-ray crystallographic coordinates of PEPREF; and (b) a processor in electrical communication with the memory; wherein the processor generates a molecular model having a three dimensional shape representative of PEPREF. In one particular example, said coordinates are stored on a computer readable diskette.

XXII. Kits

The present disclosure provides a variety of kits for conveniently and/or effectively carrying out methods and uses of the present invention. Typically, kits will comprise sufficient amounts and/or numbers of components to allow a user to perform multiple treatments of a subject(s) and/or to perform multiple experiments.

In one aspect, the present disclosure provides kits for pharmaceutical, dermatological, prophylactic, diagnostic, imaging or cosmetic functional association, combination or composition production, comprising at least one (modified) GFR-binding compound as defined herein, at least one bioactive carrier (such as a biomaterial or medical device) as defined herein, optionally a pharmaceutically, dermatologically, prophylactically, diagnostically, imaging or cosmetically acceptable excipient, carrier, vehicle or solvent, each and every one of them provided in an amount effective to produce a pharmaceutical, dermatological, prophylactic, diagnostic, imaging or cosmetic association to induce cell differentiation, promote tissue regeneration or protect a subject from a disease, disorder or condition as defined herein, when administered in-vitro, ex-vivo or in-vivo to a mesenchymal stem cell, progenitor cell (at any stage of differentiation thereof) or to a subject carrying such a cell, and packaging and instructions.

Suitable as solvents for use in kits of the invention include physiologically acceptable solvents, PBS, filtered and deionised water such as Milli-Q® water, alpha-MEM, DMEM and/or IMDM. All physiologically acceptable solvents suitable for implementing embodiments of the present invention are preferably deoxygenated before use.

In one example, said kit further comprises an administration device. In one example, said administration device is a dispensing device such as a syringe.

In one example, said kit comprises a first container containing a (modified) GFR-binding compound as defined herein and a second container containing a bioactive carrier such as a biomaterial or a medical device and a third container containing stem cells, preferably MSCs.

In one preferred example, a kit of the invention comprises (i) a first, preferably suitable, sterile, individual, container containing a (modified) GFR-binding compound as defined herein preferably in lyophilised form, (ii) a second, preferably suitable, sterile, individual, container containing a physiologically acceptable, sterile liquid (e.g. a solvent), (iii) a third, preferably suitable, sterile, individual, container containing a conventional biomaterial/medical device such as an orthopaedic or dental implant and, (iv) optionally, a fourth, preferably suitable, sterile, individual, container containing suitable stem cells, in particular adult stem cells or mesenchymal stem cells. In practice, said kit may be provided to an end-user (e.g. a surgeon). Said end-user may firstly pour the content of the second container into the first container, optionally provide a form of agitation to solubilise or suspend the (modified) GFR-binding compound of the invention in the physiologically acceptable, sterile liquid, then pour (or immerse) the resulting solution or suspension in the third container containing the conventional biomaterial/medical device (optionally with prior activation of said biomaterial/medical device if required), optionally followed by the contacting of the resulting functionalised biomaterial/medical device with the content of the fourth container containing the stem cells prior to placement onto or into a patient's body, preferably at a defect site.

Alternatively, a kit of the invention may comprise a first, preferably suitable, sterile, individual, container containing an already functionalised biomaterial/medical device e.g. a biomaterial/medical device functioanlised with a (modified) GFR-binding compound as defined herein, optionally in a physiologically acceptable liquid, and a second, preferably suitable, sterile, individual, container containing suitable stem cells, in particular adult stem cells or mesenchymal stem cells. In practice, an end-user such as a surgeon may apply the stem cells onto the coated biomaterial by pouring the content of the second container into the first containing (and optionally apply a form of agitation) prior to placement onto or into a patient's body, preferably at a defect site.

In one particular example, said kits of the invention may suitably be provided in the form of a sterile packaging.

For example, in certain embodiments, said kits of the invention comprises more than 2, between 2 and 25, between 2 and 15, or between 2 and 10 of (modified) GFR-binding compound as defined herein, and more than 2, between 2 and 25, between 2 and 15, or between 2 and 10 (modified) GFR-binding compound as defined herein.

In one example, each (modified) GFR-binding compound and each conventional or functionalised bioactive carrier is conditioned in distinct and separated compartments, in lyophilised form, in solution or in suspension in a pharmaceutically dermatologically, prophylactically, diagnostically, imaging or cosmetically acceptable excipient, carrier or vehicle.

In one aspect, the invention discloses kit-of-parts comprising a bioactive carrier and a (modified) GFR-binding compound both as defined herein for uses and methods as defined herein.

XXIII. Sequence Listing

Sequence Listing Free Text: Xaa may be, as specified, either a serine (Ser, S) or a cysteine (Cys, C). Examples of (modified) GFR-binding compounds as defined herein are listed in the appended sequence listing which forms an integral part of the present application.

(Modified) GFR-binding compounds, functionalised bioactive carriers and compositions, all as defined in the present disclosure, has been found to lead to multiple and distinct advantages in terms of cell differentiation induction and tissue regeneration.

As supported by the examples of the present application, (modified) GFR-binding compounds, functionalised bioactive carriers or compositions thereof, all as defined herein, display advantages over (modified) GFR-binding compounds, functionalised bioactive carrier or compositions that do not contain it, such as:

Enhanced and/or more practical and/or more efficient and/or more cost-effective and/or more adapted to the end-user needs and/or tissue regeneration in mammals, preferably humans;

Modifying and/or enhancing and/or modulating and/or promoting and/or activating bone and/or cartilage and/or vascular and/or muscle and/or neuronal and/or blood and/or retinal and/or organs such as kidneys and lung and/or ligament/tendon and/or hair follicle and/or skin and/or adipose, tissue regeneration;

Modifying and/or enhancing and/or modulating and/or promoting and/or activating embryonic patterning;

Modifying and/or enhancing and/or modulating and/or promoting and/or activating cellular migration and wound healing;

Modifying and/or enhancing and/or modulating and/or promoting and/or activating the closure of any type of living tissue;

Modifying and/or enhancing and/or modulating and/or promoting and/or activating female fertility;

Preventing and/or suppressing or avoiding or reducing tissue degeneration in mammals, preferably humans;

Preventing and/or suppressing or avoiding or reducing bone and/or cartilage and/or vascular and/or muscle and/or neuronal and/or blood and/or retinal and/or organs such as kidneys or lungs and/or ligament/tendon and/or hair follicle and/or skin and/or adipose, tissue degeneration;

Preventing and/or suppressing or avoiding or reducing embryonic mispatterning;

Preventing and/or suppressing or avoiding or reducing cellular immobilisation and wound formation and/or progression;

Preventing and/or suppressing or avoiding or reducing the misclosure of any type of living tissue;

Preventing and/or suppressing or avoiding or reducing female infertility;

Preventing and/or suppressing or avoiding or reducing hair-loss;

Preventing/treating alopecia areata, alopecia totalis, alopecia universalis, androgenic alopecia (male pattern baldness), telogen effluvium, anagen effluvium or chemotherapy-induced alopecia;

Modifying and/or enhancing and/or modulating and/or promoting and/or activating the osteogenicity, and/or the chondrogenecity, and/or the myogenecity, and/or the endothelization and vascularization ability, and/or hair growth ability, and/or the wound healing ability, and/or the skin repair ability, and/or the tissue defect closure ability, and/or lung tissue regeneration ability, and/or renal tissue regeneration ability, and/or the neuroregeneration ability, and/or the ligament/tendon regeneration ability, and/or the female fertility ability, of a biomaterial which may be useful in the manufacturing of medical devices;

Modifying and/or enhancing and/or activating anti-ageing/anti-wrinkle effects/properties in cosmetic products;

Modifying and/or enhancing and/or activating hair growth effects/properties in pharmaceutical or cosmetic products;

Modifying and/or enhancing and/or modulating and/or promoting and/or inducing and/or activating stem cells, preferably adult stem cells, more preferably mesenchymal stem cells, commitment and/or differentiation in a specific lineage of cells;

Modifying and/or enhancing and/or modulating and/or promoting and/or inducing and/or activating progenitor cells differentiation and/or maturation.

Obtaining/producing functional differentiated cells;

Obtaining/producing differentiated cells with modified and/or improved functionality and/or physiological activity;

Increasing amount of osteoblast cells whilst (highly) reducing bone resorption activity;

Increasing bone mineralization speed, rate and surface;

Having the ability to decouple bone resorption from bone formation;

Achieving efficient bone strengthening in osteoporosis patients;

Reduced or low or substantially inexistent organ toxicity, in particular in the liver.

For example, in certain embodiments, (modified) GFR-binding compounds, functionalised bioactive carriers, or compositions according to the present disclosure in which PEP1 is a peptide selected from the group consisting of SAIS (SEQ ID NO: 6360), NAIS (SEQ ID NO: 6357), SATS (SEQ ID NO: 6361) and SPIS (SEQ ID NO: 6364), and in which the RMSD is 2.45 Å or less, have been found to lead to unexpectedly fast and qualitatively and quantitatively important osteoinduction, producing highly functional differentiated cells.

For example, in certain embodiments, (modified) GFR-binding compounds, functionalised bioactive carriers, or compositions according to the present disclosure in which PEP1 is a peptide selected from the group consisting of SAIS (SEQ ID NO: 6360), NAIS (SEQ ID NO: 6357), SPIS (SEQ ID NO: 6364), EPLP (SEQ ID NO: 6354), and EPLT (SEQ ID NO: 6355), and in which the RMSD is 2.45 Å or less, have been found to lead to unexpectedly fast and qualitatively and quantitatively important chondroinduction, producing highly functional differentiated cells.

For example, in certain embodiments, (modified) GFR-binding compounds, functionalised bioactive carriers, or compositions according to the present disclosure in which PEP1 is a peptide selected from the group consisting of SNIT (SEQ ID NO: 6362), RPVQ (SEQ ID NO: 6358) and RSVK (SEQ ID NO: 6359), and in which the RMSD is 2.45 Å or less, have been found to lead to unexpectedly fast and qualitatively and quantitatively important vascular tissue induction, producing highly functional differentiated cells.

For example, in certain embodiments, (modified) GFR-binding compounds, functionalised bioactive carriers, or compositions according to the present disclosure in which PEP1 is selected from the group consisting of NAIS (SEQ ID NO: 6357), SPIS (SEQ ID NO: 6364) and EPIS (SEQ ID NO: 6353), and in which the RMSD is 2.45 Å or less, have been found to lead to unexpectedly fast and qualitatively and quantitatively important neuronal induction, producing highly functional differentiated cells.

For example, in certain embodiments, (modified) GFR-binding compounds, functionalised bioactive carriers, or compositions according to the present disclosure in which PEP1 is SPIN (SEQ ID NO: 6363), and in which the RMSD is 2.45 Å or less, have been found to lead to unexpectedly fast and qualitatively and quantitatively important eye-retina cells induction, producing highly functional differentiated cells.

For example, in certain embodiments, (modified) GFR-binding compounds, functionalised bioactive carriers, or compositions according to the present disclosure in which PEP1 is SPIN (SEQ ID NO: 6363), and in which the RMSD is 2.45 Å or less, have been found to lead to unexpectedly fast and qualitatively and quantitatively important renal cells induction, producing highly functional differentiated cells.

For example, in certain embodiments, (modified) GFR-binding compounds, functionalised bioactive carriers, or compositions according to the present disclosure in which PEP1 is a peptide selected from the group consisting of NAIS (SEQ ID NO: 6357), SPIS (SEQ ID NO: 6364), EPLP (SEQ ID NO: 6354) and EPLT (SEQ ID NO: 6355), and in which the RMSD is 2.45 Å or less, have been found to lead to unexpectedly fast and qualitatively and quantitatively important tenocytes and/or fibrous cells induction, producing highly functional differentiated cells.

For example, in certain embodiments, (modified) GFR-binding compounds, functionalised bioactive carriers, or compositions according to the present disclosure in which PEP1 is selected from the group consisting of SNIT (SEQ ID NO: 6362), RPVQ (SEQ ID NO: 6358) and RSVK (SEQ ID NO: 6359), and in which the RMSD is 2.45 Å or less, have been found to lead to unexpectedly fast and qualitatively and quantitatively important wound healing induction, producing highly functional differentiated cells.

For example, in certain embodiments, (modified) GFR-binding compounds, functionalised bioactive carriers, or compositions according to the present disclosure in which PEP1 is a peptide selected from the group consisting of EPLP (SEQ ID NO: 6354), EPLT (SEQ ID NO: 6355), RSVK (SEQ ID NO: 6359) and RPVQ (SEQ ID NO: 6358), and in which the RMSD is 2.45 Å or less, have been found to lead to unexpectedly fast and qualitatively and quantitatively important skin cells induction, producing highly functional differentiated cells.

For example, in certain embodiments, (modified) GFR-binding compounds, functionalised bioactive carriers, or compositions according to the present disclosure in which PEP1 is SSLS (SEQ ID NO: 6365), and in which the RMSD is 2.45 Å or less, have been found to lead to unexpectedly fast and qualitatively and quantitatively important hair follicle cells induction, producing highly functional differentiated cells.

For example, in certain embodiments, (modified) GFR-binding compounds, functionalised bioactive carriers, or compositions according to the present disclosure in which PEP1 is NAIS (SEQ ID NO: 6357), and in which the RMSD is 2.45 Å or less, have been found to lead to unexpectedly fast and qualitatively and quantitatively important ovarian cells induction, producing highly functional differentiated cells.

For example, in certain embodiments, (modified) GFR-binding compounds, functionalised bioactive carriers, or compositions according to the present disclosure in which PEP1 is selected from the group consisting of NAIS (SEQ ID NO: 6357), SATS (SEQ ID NO: 6361), SPIS (SEQ ID NO: 6364), EPIS (SEQ ID NO: 6353) and SPIN (SEQ ID NO: 6363), and in which the RMSD is 2.45 Å or less, have been found to lead to unexpectedly fast and qualitatively and quantitatively important lung cells induction, producing highly functional differentiated cells.

For example, in certain embodiments, (modified) GFR-binding compounds, functionalised bioactive carriers, or compositions according to the present disclosure in which PEP1 is RSVK (SEQ ID NO: 6359) or RPVQ (SEQ ID NO: 6358), and in which the RMSD is 2.45 Å or less, have been found to lead to unexpectedly fast and qualitatively and quantitatively important muscle cells induction, producing highly functional differentiated cells.

For example, in certain embodiments, (modified) GFR-binding compounds, functionalised bioactive carriers, or compositions according to the present disclosure in which PEP1 is SNIT (SEQ ID NO: 6362), and in which the RMSD is 2.45 Å or less, have been found to lead to unexpectedly fast and qualitatively and quantitatively important blood cells induction, producing highly functional differentiated cells.

For example, in certain embodiments, (modified) GFR-binding compounds, functionalised bioactive carriers, or compositions according to the present disclosure in which PEP1 is SAIS (SEQ ID NO: 6360) or NAIS (SEQ ID NO: 6357), and in which the RMSD is 2.45 Å or less, have been found to lead to unexpectedly fast and qualitatively and quantitatively important adipocytes induction, producing highly functional differentiated cells.

For example, in certain embodiments, microenvironments comprising a plurality of structurally distinct/different (modified) GFR-binding compounds, functionalised bioactive carriers, or compositions according to the present disclosure in which each PEP1 is a peptide which may be selected from the group consisting of SAIS (SEQ ID NO: 6360), SSLS (SEQ ID NO: 6365), NAIS (SEQ ID NO: 6357), SATS (SEQ ID NO: 6361), SPIS (SEQ ID NO: 6364), EPIS (SEQ ID NO: 6353), SPIN (SEQ ID NO: 6363), KPLS (SEQ ID NO: 6356), EPLP (SEQ ID NO: 6354), EPLT (SEQ ID NO: 6355), SNIT (SEQ ID NO: 6362), RSVK (SEQ ID NO: 6359) and RPVQ (SEQ ID NO: 6358), and in which the RMSD is 2.45 Å or less, have been found to lead to unexpectedly fast and qualitatively and quantitatively important tissue closure induction, producing highly functional differentiated cells.

Accordingly, it is possible to achieve tissue (bone, cartilage, vascular, endothelial, blood, neuronal, eye-retina, kidneys, lung, adipose, ligament, tendon, hair follicle, skin, ovary, etc.) regeneration using e.g. orthopedic, dental implants, matrix injections or administrable compositions, efficiently and rapidly thus reducing the costs associated with such treatments, improving and accelerating tissue healing and patient recovery.

In addition, it has been found that using the compounds, bioactive carrier and compositions of the present disclosure also permits a quasi-complete or complete control over the final chemical structure of the compounds, bioactive carrier and compositions of the present disclosure, thereby avoiding any unwanted (e.g. post-translational) modifications and unpredicted short half-life and quick metabolization.

Remarkably, it has also been found that using the compounds, bioactive carrier and compositions of the present disclosure allows for reduction (in most cases, important reduction) of the administered doses to provide a beneficial treatment to a patient in comparison with known technologies, thus decreasing or eliminating the risks of immune responses and reduce or eliminate drug/treatment toxicity.

It is another aspect of the present invention to solve the technical problem of providing a tissue regeneration environment/system being completely or at least partially devoid of one or more, preferably a plurality of the disadvantages of known treatments.

All combinations of any of the above-mentioned features described in all above part of the present description are specifically contemplated by the Applicant to be within the scope of the present invention unless contradictory in context. Examples of such combinations are detailed throughout the present description.

Further embodiments and advantages will become apparent to a skilled reader in light of the examples provided below.

EXAMPLES

Disclosed and described, it is to be understood that this invention is not limited to the particular examples, process steps, and materials disclosed herein as such process steps and materials may vary somewhat. It is also to be understood that the terminology used herein is used for the purpose of describing particular embodiments only and not intended to be limiting since the scope of the present invention will be limited only by the appended claims and equivalents thereof.

The following Examples are representative of techniques employed by the inventor in carrying out aspects of the present invention. It should be appreciated that while these techniques are exemplary of preferred embodiments for the practice of the invention, those of skill in the art, in light of the present disclosure, will recognize that numerous modifications can be made without departing from the spirit and intended scope of the invention.

The following starting materials and reagents were used:
Apatite ceramics (also called apatite or ceramic in the present invention) were synthetized as described in Mater Res. 2004; 7(4): 625-630.
Titanium was obtained from Goodfellow®.
Hydrogel (poly(acrylamide-co-acrylic acid) gel) was synthetized as described in Langmuir 2011; 27(22):13635-42.
PEEK was obtained from Goodfellow®.
PET (Poly(ethylene terephthalate) was obtained from Goodfellow®.
Type-1 collagen sponge was obtained from Sigma®.
Hexane was obtained from Sigma®.
3-succinimidyl-3-maleimidopropionate (SMP) was obtained from Sigma®.
DMF was obtained from Sigma®.
PBS 1× was obtained from Gibco®.
3-(ethoxydimethylsilyl)propylamine was obtained from Sigma®.
Ammonium persulfate was obtained from Biorad®.
N,N,N',N'-tetramethylethylenediamine was obtained from Aldrich®.
Acrylamid was obtained from Merck®.
Acrylic acid was obtained from Merck®.
N,N-methylene-bis-acrylamide was obtained from Merck®.
NaOH was obtained from Aldrich®.
N,N,N',N'-tetramethylethylenediamine was obtained from Aldrich®.
Dimethylaminopropyl-3-ethylcarbodiimide hydrochloride was obtained from Aldrich®.
N-hydroxysuccinimide was obtained from Aldrich®.
2-(N-morpholino)-ethane sulfonic acid was obtained from Aldrich®.
MilliQ water: is water characterised in terms of resistivity (typically 18.2 MΩ·cm at 25° C.).
Low glucose Dulbecco's Modified Eagle Medium (DMEM) was obtained from Invitrogen®
Minimum Essential Medium Eagle without ascorbic acid (αMEM) was obtained from Invitrogen®.

All of the cell culture experiments were carried out without any serum in the medium for the first 8 hours of culture.

Osteoblast progenitors or precursor osteoblasts: MC3T3-E1 cells were obtained from ATCC®. These cells were cultured in Alpha-MEM medium supplemented with 10% fetal calf serum (FCS) and 1% penicillin/streptomycin. All cells were used at a low passage number (passage 7), were subconfluently cultured and were seeded at $10^4$ cells/cm$^2$ for the purpose of the experiments.

Human bone marrow Mesenchymal Stem Cells (hMSCs) were obtained from Lonza®. These cells were cultured in Alpha-MEM supplemented with 10% (v/v) FBS and 1% penicillin/streptomycin and incubated in a humidified atmosphere containing 5% (v/v) $CO_2$ at 37° C. All cells were used at a low passage number (passage 2 to 4), were subconfluently cultured and were seeded at $10^4$ cells/cm$^2$ for the purpose of the experiments.

Human adipose Mesenchymal Stem Cells (haMSCs) were obtained from Lonza®. These cells were cultured in Alpha-MEM supplemented with 10% (v/v) FBS and 1% penicillin/streptomycin and incubated in a humidified atmosphere containing 5% (v/v) $CO_2$ at 37° C. All cells were used at a low passage number (passage 3 to 4), were subconfluently cultured and were seeded at $10^4$ cells/cm$^2$ for the purpose of the experiments.

Mouse Hair Follicle Stem Cells were isolated and cultured as described in Methods Mol Biol. 2010; 585: 401-20.

Neuron cells are Neuronal Schwann Cells obtained from ATCC®. These cells were cultured in Dulbecco's Modified Eagle's Medium supplemented with 10% (v/v) FBS and 1% penicillin/streptomycin and incubated in a humidified atmosphere containing 5% (v/v) $CO_2$ at 37° C. All cells were used at a low passage number (passage 6-8), were subconfluently cultured and were seeded at $10^4$ cells/cm$^2$ for the purpose of the experiments.

Human umbilical-vein endothelial cells (HUVECs) were purchased from Promocell®. HUVECs were isolated and grown on gelatin coated culture flasks in a complete HUVEC culture medium (IMDM (Invitrogen, France) supplemented with 20% (v/v) fetal bovine serum (FBS) (PAA, France) and 0.4% (v/v) EC growth supplement/heparin kit (Promocell, France)). Cells were subcultured by using trypsin/EDTA (Invitrogen, France) and maintained in a humidified atmosphere containing 5% $CO_2$ at 37° C. These cells were used at a passage number 3 to 5 for the purpose of the experiments. HUVECs were seeded on each surface at a density of 50000 cells/cm$^2$.

Human Mammary Epithelial Cells (HMEC) were obtained from Lonza®. These cells were cultured in Clonetics™ MEGM™ Mammary Epithelial Cell Growth Medium.

Hematopoietic stem (Bone marrow CD34+ cells, Lonza). These cells were cultured on HPGM™ Hematopoietic Growth Medium in serum-free culturing.

CMFDA is a Cell Tracker Green obtained from Invitrogen®.

DAPI was obtained from Sigma®.

Fetal bovine serum (FBS) was obtained from Gibco®.

Penicillin/streptomycin was obtained from Invitrogen®.

The AlamarBlue® assay was obtained from Molecular Probes®.

Runx2 antibody was obtained from Abcam®.

Osterix antibody was obtained from Santa Cruz Biotechnology®.

Osteopontin antibody was obtained from Abcam®,

Stro-1 antibody was obtained from Abcam®,

Sox2 antibody was obtained from Santa Cruz Biotechnology®.

Sox9 antibody was obtained from Santa Cruz Biotechnology®.

BMP-6 antibody was obtained from Abcam®,

CD31 (PECAM-1) antibody was obtained from Invitrogen®,

Primers for GAP 43: 5'-AAGCTACCACTGATAACTCGCC-3' (SEQ ID NO: 6613) (Forward) and 5'-CTTCTTTACCCTCATCCTGTCG-3' (SEQ ID NO: 6614) (Reverse) were obtained from Invitrogen®.

Primers for Aggrecan: 5'-CACTGTTACCGCCACTTCCC-3' (SEQ ID NO: 6615) (Forward) and 5'-ACCAGCGGAAGTCCCCTTCG-3' (SEQ ID NO: 6616) (Reverse) were obtained from Invitrogen®.

Primers for COMP: 5'-GCTCTGTGGCATACAGGAGA-3' (SEQ ID NO: 6617) (Forward) and 5'-CATAGAATCGCACCCTGATG-3' (SEQ ID NO: 6618) were obtained from Invitrogen®.

Primers for Runx2: 5'-GACGTGCCCAGGCGTATTTC-3' (SEQ ID NO: 6619) (Forward) and 5'-AAGTCTGGGGTCCGTCAAGG-3' (SEQ ID NO: 6620) (Reverse) were obtained from Invitrogen®.

Primers for HPRT: 5'-GCAGTACAGCCCCAAAATGG-3' (SEQ ID NO: 6621) (Forward) and 5'-ACAAAGTCCGGCCTGTATCCAA-3' (SEQ ID NO: 6622) (Reverse) were obtained from Invitrogen®.

All peptides were synthetized using conventional solution and/or solid phase peptide synthesis methods.

All experiments were carried out with a concentration of compounds of the invention of 400 ng/mL. When cell culture duration extended beyond 24 h, a further 400 ng/mL solution of compounds of the invention was added every 24 h.

In all the following exemplified peptide sequences, X1 (or Xaa) is a serine (Ser, S).

The Following General Methods were Used:

X-Ray Photoelectron Spectroscopy:

For X-ray photoelectron spectroscopy, AVG Scientific ESCALAB photoelectron spectrometer was used for the surface analysis with a non-monochromatized MgK 1253.6 eV source of 100 W. The area of the analytical X-ray spot on the sample surface was about 200 μm$^2$. A 45° insert angle that corresponds to about 5 nm of analyzed depth was used. A flood gun was used for charge compensation. Acquisition of high resolution spectra was performed at constant pass energy of 20 eV.

Optical Profilometry Probing:

The surface profiler system is a non-contact optical profiler that measures a wide range of surface heights. The vertical scanning interferometry mode allows for the measurement of rough surfaces and steps of up to several micrometers. This mode was used in order to measure the thickness of the extracellular matrix produced by the cells. First, after 24 h of culture, the cells were fixed with paraformaldehyde in PBS (4%) for 30 minutes at 4° C. and the samples were dehydrated in increasing concentrations of ethanol (30, 70, 80, 90, 95 and 100%) and critical-point dried. To evaluate the extent of the newly synthesized extracellular matrix, a spatula was used to scratch the surface of the materials. The samples were then metallized for 10 sec with gold or titanium before being analyzed. This procedure did not affect the cell shape and dimensions.

Immunostaining:

The cells were first fixed for 20 min with 4% paraformaldehyde/PBS at 4° C. After fixation, the cells were permeabilized in PBS containing 1% Triton X-100 for 15 min. Runx2, Osterix, Stro-1, Vinculin, Phalloidin, Osteopontin, Sox2, Sox9 antibodies were visualized by treating the cells with 1% (v/v) specific monoclonal antibodies for 1 hour at 37° C. Then the samples were incubated with Alexa fluor® 568 or 647 (F(ab')2 fragment of IgG(H+L)) during 30 min at room temperature. The cell nuclei were counterstained in 20 ng/mL DAPI for 10 min at room temperature.

Quantification of Positive Contact Numbers and Areas:

For this type of quantification the freeware image analysis ImageJ® software was used. The raw image was first converted to an 8-bit file, and then the unsharp mask feature was used (settings 1:0.2) to remove the image background (rolling ball radius 10). After smoothing, the resulting image, which appears similar to the original photomicrograph but with minimal background, was then converted to a binary image by setting a threshold. Threshold values were determined empirically by selecting a setting, which gave the most accurate binary image for a subset of randomly selected photomicrographs. The cell area was determined by manual delineation on raw fluorescent images. Total contact area and mean contact area per cell were calculated by "analyse particles" in ImageJ®. A minimum of 30 cells per condition were analyzed. Stro-1, CD-34+, and CD-105 expressions were determined using this procedure.

Quantitative Real Time Polymerase Chain Reaction (Q-PCR):

Total RNA was extracted by using the RNeasy total RNA kit (Qiagen®) according to the manufacturer's instructions. Purified total RNA was used as a template in order to make cDNA by a reverse transcription reaction (Gibco Brl®) with random primers (Invitrogen®). The cDNA was then used as a template for a real-time PCR amplification in the presence of SYBR green reagents (Bio-Rad®) by using a thermocycler (iCycler, Biorad®). Data were analyzed with the iCycler IQ™® software and compared by the ΔΔCt method. Briefly, the mean Ct value of the target gene was normalized to its averaged Ct values of the housekeeping gene (HPRT) to give a ΔCt value, which was then normalized to a control sample to obtain a ΔΔCt value.

The results were obtained from two series of experiments performed in a triplicate.

Semi-Quantitative RT-PCR:

Total RNA was extracted by using the RNeasy Mini Kit (Qiagen) and 1 mg RNA was used for cDNA synthesis with AMV kit (Invitrogen®) according to the manufacturer' instructions. Semi-quantitative reverse transcriptase-polymerase chain reaction (RT-PCR) was performed with Taq DNA Polymerase (Invitrogen®) in a thermocycler (Bio-Rad®). The cDNA input was normalized to glyceraldehyde-3-phosphate dehydrogenase (HPRT). The PCR products were analyzed on 2% agarose gels. For the Aggrecan gene, the PCR bands were densitometrically quantified by using the BioCapt software (Vilber). Values were normalized to HPRT, and results were reported as relative gene expression.

General Procedure Used for the Covalent Depositing of the GFR-Binding Compounds as Defined Herein onto Biomaterials Method 1: Hydrogel Surface Preparation and Covalent Grafting (Such as PLLA)

The preparation of poly(acrylamide-co-acrylic acid) gel substrates was shown as an example in order to illustrate the effect of the GFR-binding compounds as defined herein. The synthesis of hydrogels is based on acrylamide and acrylic acid by polymerization in the presence of N,N'-methylene-bis-acrylamide as a cross-linker in an aqueous medium. Practically, 0.3 g of acrylamide (AM, Merck) has been dissolved in 5 mL of PBS 1× (Invitrogen). 30 μL of acrylic acid (AA, Merck), then x g (function as the stiffness) of N,N-methylene-bis-acrylamide was added under stirring. Then, a NaOH solution (1M, Aldrich) was added dropwise to reach a pH 8. The formation of hydrogel proceeded via free radical polymerization. The starting solution was degassed during 10 min by bubbling nitrogen in order to remove the oxygen which acts as an inhibitor for the free radical polymerization process. Nitrogen atmosphere was maintained above the solution and 50 μL (corresponding to 1/100 of the total volume) of Ammonium persulfate 10% (Biorad), (free radical initiator) and then 5 μL (corresponding to 1/1000 of total volume) of N,N,N',N'-tetramethylethylenediamine (catalyst, Aldrich) were added. The polymerizing solution was vortexed gently. Promptly, 0.5 mL of this gel solution was placed before polymerization on a glass slide and another slide was placed on the top of this structure. Reactivity ratios calculated by the Finemann-Ross and Kelen-Tudos methods showed that the copolymers were random with a reactivity ratio of rAM=3.76 and rAA=0.28. The materials obtained here have various stiffnesses ranging from 0.1 to 600 kPa. Chemical functionalization with GFR-binding compounds as defined herein of poly(acrylamide-co-acrylic acid) gel substrates was performed via the —COOH (carboxyl) functions of their surface. Hydrogels were immersed in a solution of dimethylaminopropyl-3-ethylcarbodiimide hydrochloride (EDC, 0.2 M)+N-hydroxysuccinimide (NHS, 0.1 M) in 2-(N-morpholino)-ethane sulfonic acid (MES buffer, 0.1 M in MilliQ water) overnight at room temperature without stirring and then rinsed in MilliQ water (50 mL during 30 min). The immobilization of the GFR-binding compounds as defined herein was achieved in a solution of peptides/PBS 1× (C=$10^{-3}$ M) for 18 hours at room temperature by using an orbital shaker. After grafting, the modified hydrogels were rinsed with PBS 1× for one week.

Method 2: Solid Material Covalent Modification (Such as Ceramics or Titaniums)

The material modifications were performed in a controlled Atmosphere (Ar Atmosphere, Glove Box). The strategy for covalent modification of GFR-binding compounds as defined herein involved (1) grafting of (3-aminopropyl)-triethoxysilane (concentration of 1×$10^{-2}$M, 4 hours) onto the surface of the biopolymer, (2) substitution of the terminal amine by a hetero-bifunctional cross-linker, a 3-succinimidyl-3-maleimidopropionate (concentration of 1×$10^{-3}$M, 4 hours) in order to (3) reacting of the "outer" maleimide group with the GFR-binding compounds as defined herein (concentration of 1×$10^{-3}$M, 18 hours) via a thiol group present in the terminal cysteine. After grafting, the modified materials were rinsed with PBS 1× buffer for 5 days.

Method 3: Polymer Grafted by Peptides (Such as PET or PEEK)

The polymer used in this study is poly(ethylene terephthalate) (PET). The polymers were first treated in order to create —COOH (carboxyl) functions on the PET surfaces from —OH (hydroxyl) functions. Next, the PET-COOH samples were immersed in a solution of dimethylaminopropyl-3-ethylcarbodiimide hydrochloride (EDC, 0.2 M)+N-hydroxysuccinimide (NHS, 0.1 M) in 2-(N-morpholino)-ethanesulfonic acid (MES) buffer (0.1 M in MilliQ water) and the samples were rinsed in MilliQ water (50 mL for 30 min). The same protocol was used for all the polymers containing —OH (hydroxyl) functions on their extreme surface. Finally, the covalent immobilization of the peptides was achieved by using a solution of peptides/1×PBS (C=10$^{-3}$ M) incubated for 18 hours at room temperature. After grafting, the materials were rinsed in MilliQ water (100 ml) for 1 week.

Example 1: Covalent Depositing of GFR-Binding Compounds as Defined Herein onto Conventional Titanium The material modifications were performed in a Specific Atmosphere (Ar Atmosphere, Glove Box). The strategy for the covalent peptide immobilization involved (1) the grafting of (3-aminopropyl)-triethoxysilane (concentration of 1×10$^{-2}$M, 4 hours) onto the surface of the implant, (2) substitution of the terminal amine by a hetero-bifunctional cross-linker: a 3-succinimidyl-3-maleimidopropionate (concentration of 1×10$^{-3}$M, 4 hours) in order to (3) react the "outer" maleimide group with an osteogenic peptide (concentration of 1×10$^{-3}$M, 24 hours) via a thiol group present in the terminal cysteine. After covalent immobilization, the modified materials were rinsed with Phosphate Buffered Saline (PBS 1×) buffer for 5 days. PBS is a buffer solution commonly used in the biological research. It is a water-based salt solution containing sodium phosphate, sodium chloride and, in some formulations, potassium chloride and potassium phosphate. The osmolarity and ion concentrations of the solutions match those of the human body (isotonic) and are thus physiological and non-toxic to the cells.

The following peptides were covalently deposited via the thiol group present in the terminal cysteine that was added to the GFR-binding compounds to allow covalent bonding to the surface of the biomaterial:

| | |
|---|---|
| SEQ ID NO: 1 | CGSAGPSSVPTKMSAISMLYL |
| SEQ ID NO: 2 | CAAPASSSVPTRLSAISMLYL |
| SEQ ID NO: 3 | CSTPPTSSVPTRLSAISMLYL |
| SEQ ID NO: 4 | CNDEGLESAPTEENAISVLYF |
| SEQ ID NO: 5 | CNDEGLESAPTGQNAISVLYF |
| SEQ ID NO: 6 | CKIPKASSVPTELSATSVLYY |
| SEQ ID NO: 9 | CHVTKPTSVPEKLSSLSILFF |
| SEQ ID NO: 10 | CKVGKASSVSQKLEPLTILYY |
| SEQ ID NO: 11 | CRNVQSRPTQVQLNAISVLYF |
| SEQ ID NO: 12 | CHVPKPSSAPTKLSAISMLYL |
| SEQ ID NO: 13 | CKVGKASSVPTKLEPLTILYY |
| SEQ ID NO: 14 | CRNVQSRPTQVQLSAISMLYL |
| SEQ ID NO: 15 | CASASPSSVSQDLSAISMLYL |
| SEQ ID NO: 16 | CHVPKPSSVPTKLSPISVLYK |
| SEQ ID NO: 17 | CNDEGLESVPTGQNAISVLYF |
| SEQ ID NO: 18 | CTVPKPSSAPTQLSAISMLYL |
| SEQ ID NO: 19 | CAVPKASSAPTKLSAISMLYL |
| SEQ ID NO: 20 | CKVGKASSVPTKLSAISMLYL |
| SEQ ID NO: 43 | CRVPSTSSVPAKTSPISILYI |
| SEQ ID NO: 44 | CASAAPSSVPAALSPISILYI |
| SEQ ID NO: 45 | CNDEGLESVPAEESPISILYI |
| SEQ ID NO: 46 | CVPAGQSPISILYI |
| SEQ ID NO: 47 | CNDEGLESVPAEESPISILYI |
| SEQ ID NO: 48 | CVPAEESPISILYI |
| SEQ ID NO: 49 | CGIPEPSSVPAKMSPISILYI |

The biomaterial surface was characterized by covalently immobilizing fluorescent peptides (Herein SEQ ID NO: 1 coupled to fluorescein isothiocyanate (FITC), FIG. 1) and X-ray photoelectron spectroscopy (Table 1, 2 and 3). The X-ray photoelectron spectroscopy was performed as described in the Methods section. The results presented in Table 1 were obtained for a titanium alloy material (Ti6A14V metal alloy pellets) covalently modified with SEQ ID NO: 2 to 6.

TABLE 1

| Name | At. % C1s | At. % N1s |
|---|---|---|
| Titanium | 29.07 | no detection |
| Titanium grafted covalently with SEQ ID NO: 2 | 42.68 | 3.98 |
| Titanium grafted covalently with SEQ ID NO: 3 | 43.22 | 5.07 |
| Titanium grafted covalently with SEQ ID NO: 4 | 40.85 | 4.18 |
| Titanium grafted covalently with SEQ ID NO: 5 | 40.51 | 5.39 |
| Titanium grafted covalently with SEQ ID NO: 6 | 43.78 | 4.09 |

Example 2: Covalent Depositing of GFR-Binding Compounds as Defined Herein onto Conventional PEEK Material A polyetheretherketone (PEEK) was treated with ethylene diamine (NH$_2$=NH$_2$) to create —NH$_2$ (amine) functions on the PEEK surfaces from ketone (=O) functions. Next, the PEEK-NH$_2$ samples were immersed in a solution of a hetero-bifunctional cross-linker: a 3-succinimidyl-3-maleimidopropionate (concentration of 1×10$^{-3}$M, 4 hours) in order to react the "outer" maleimide group with the GFR-binding compounds as defined herein (concentration of 1×10$^{-3}$M, 24 hours) via a thiol group present in the terminal cysteine. After grafting, the modified materials were rinsed with PBS 1× for 5 days.

The surfaces were characterized by grafting fluorescent peptides and by other methods such as X-ray photoelectron spectroscopy. The X-ray photoelectron spectroscopy was performed as described in the Methods section.

The results presented in Table 2 were obtained by using a PEEK covalently modified with SEQ ID NO: 7.

TABLE 2

| Name | At. % C1s | At. % N1s |
|---|---|---|
| PEEK | 86.56 | no detection |
| PEEK grafted covalently with SEQ ID NO: 7 | 70.79 | 4.59 |

Example 3: Covalent Depositing of GFR-Binding Compounds as Defined Herein onto PLLA PLLA (Polylactic acid) was immersed in a solution of dimethylaminopropyl)-3-ethylcarbodiimide hydrochloride (EDC, 0.2 M)+N-hydroxysuccinimide (NHS, 0.1 M) in (2-(N-morpholino)-ethanesulfonic acid (MES buffer, 0.1 M in MilliQ water) and then rinsed in MilliQ water (during 30 min). The covalent immobilization was performed in a solution of GFR-binding compounds as defined herein SEQ ID NO: 8 (concentration of $1\times10^{-3}$M, 18 hours, room temperature). After the covalent immobilization, the modified materials were rinsed with PBS 1× for 5 days.

The surfaces were characterized by using fluorescent peptides and by using other methods such as X-ray photoelectron spectroscopy. The X-ray photoelectron spectroscopy was performed as described in the Methods section.

The results presented in Table 3 were obtained by using a PLLA covalently modified with SEQ ID NO: 8.

TABLE 3

| Name | At. % C1s | At. % N1s |
|---|---|---|
| PLLA | 69.02 | no detection |
| PLLA grafted covalently with SEQ ID NO: 8 | 71.38 | 5.21 |

Example 4: Proliferation of Progenitor Bone Cells

Figure 2:
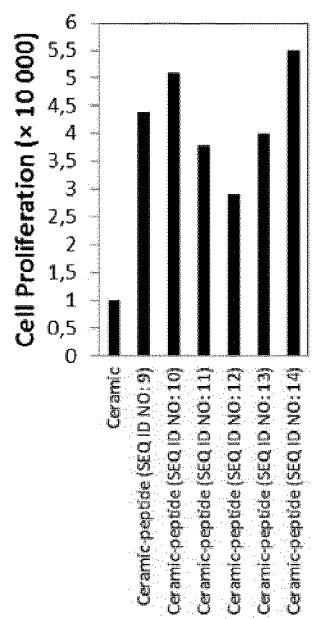
FIG. 2 is a diagram showing a proliferation of osteoblast precursors after 48 hours of culture on a native apatite ceramic biomaterial and on a covalently modified apatite ceramic biomaterial according to the present disclosure.

The effect of the GFR-binding compounds as defined herein (SEQ ID NO: 9 to 14) of the invention on the proliferation of osteoblast progenitors (MC3T3-E1 cells, ATCC®) was investigated. The stimulatory effect of apatite ceramics, covalently modified with at least one inducing peptide of the invention, on osteoblast progenitor cells was compared with the effect of non-modified apatite ceramics, which are conventionally used to manufacture bone implants suitable for humans and animals. The AlamarBlue® assay was used to compare the extent of cell proliferation on the different biomaterials based on detection of metabolic activity. Analysis of these data showed that the proliferation was increased significantly on apatite ceramics covalently modified with GFR-binding compounds as defined herein in comparison with conventional non-modified ceramics (FIG. 2).

Example 5: Osteogenic Differentiation of Human Mesenchymal Stem Cells

The biomaterial used was titanium Ti6Al4V metal alloy pellets. Human Mesenchymal Stem Cells (hMSCs) were obtained from Lonza®, Inc. Cells were then cultured in low glucose Dulbecco's Modified Eagle Medium (DMEM, Invitrogen®) supplemented with 10% (v/v) fetal bovine serum (FBS), 1% penicillin/streptomycin and incubated in a humidified atmosphere containing 5% (v/v) $CO_2$ at 37° C. All the cells were used at a low passage number (5 passage 3), were subconfluently cultured and were seeded at 10 000 cells/cm² for the purpose of the experiments. Stem cell phenotype was analyzed after 62 hours of cell culture on titanium covalently modified with GFR-binding compounds as defined herein (SEQ: ID NO: 15 to 20).

To probe this lineage specification, immunostaining for Runx2 and Osterix was performed after cell fixation as described in the Methods section. The quantification of Runx2 and Osterix positive contact numbers and areas was performed as described in the Methods section.

Figure 3:
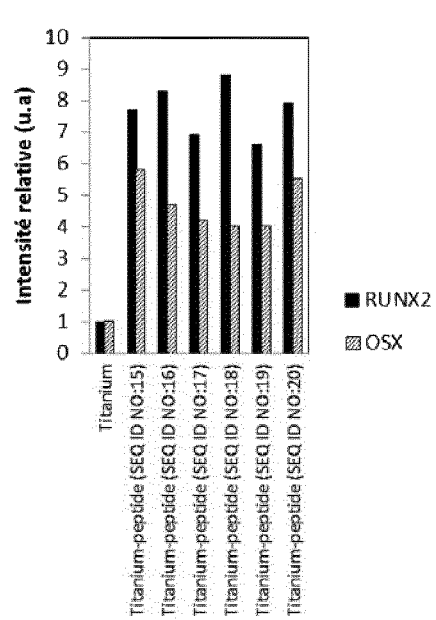
FIG. 3 is a diagram representing a commitment of human Bone Marrow Mesenchymal Stem Cells towards osteoblast-like cells after 62 hours of culture on titanium biomaterials covalently modified according to the present disclosure using Runx2 and Osterix immunofluorescent stainings.

As shown in FIG. 3, when cultured on covalently modified titanium of the invention, the vast majority of the human bone marrow mesenchymal stem cells adheres, spreads, and differentiates into osteoblast-like cells, which was confirmed by increase in the Runx2 and Osterix protein expression (FIG. 3).

Example 6: Osteogenic Differentiation of Osteoblast Progenitors

A conventional PEEK carrier was covalently modified with the GFR-binding compounds as defined herein (SEQ ID NO: 21) to produce biomaterials of the invention, and mouse mesenchymal pre-osteoblastic cells (MC3T3-E1, from ATCC®) were cultured thereon. MC3T3-E1 cells were cultured in Alpha-MEM medium supplemented with 10% fetal calf serum (FCS) and 1% penicillin/streptomycin. All the cells were used at a low passage number (passage 4) and were subconfluently cultured. The cells were plated at 10 000 cells/cm² for the purpose of these experiments. The extracellular matrix production was compared between cells cultured on conventional PEEK biomaterials and cells cultured on PEEK biomaterials covalently modified with the GFR-binding compounds as defined herein (SEQ ID NO: 21) after 24 h of cell culture. This was performed by using optical profilometry system probing as described in the Methods section.

Figure 4:
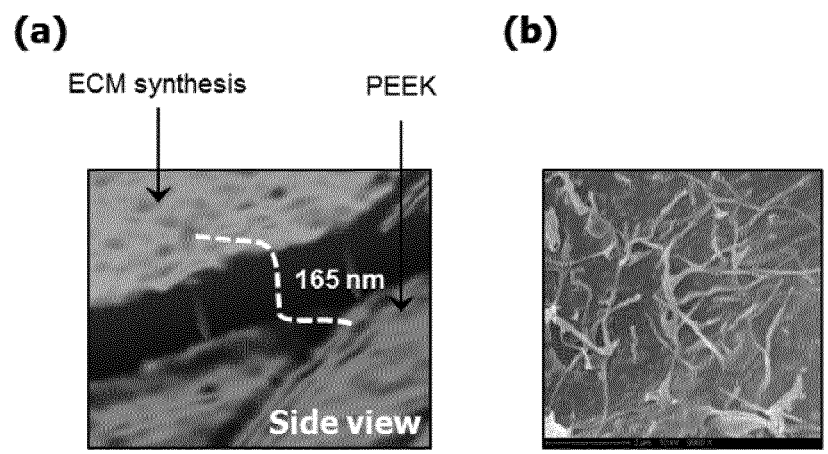
FIG. 4 are (a) diagram representing an Optical Profilometry micrograph showing an extracellular matrix (ECM) produced by osteoblast precursors cultured for 24 h on a titanium biomaterial covalently modified according to the present disclosure. (b) Scanning Electron Microscopy showing ECM (collagen fibers) produced by differentiated cells.

As shown in FIG. 4, the PEEK biomaterials of the invention i.e. conventional PEEK biomaterials covalently modified with at least one type of GFR-binding compounds as defined herein, allow for the differentiation of mouse mesenchymal pre-osteoblastic cells into mature osteoblasts after 24 hours of culture as shown by the synthesis of extracellular matrix such as collagen fibers (FIG. 4b).

Figure 5:
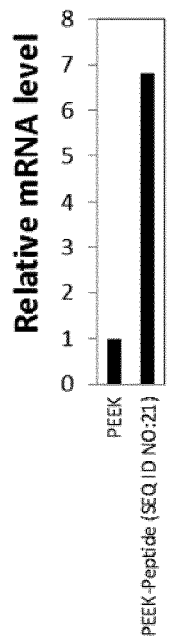
FIG. 5 is a diagram representing a Quantitative Real Time PCR analysis for the expression of Runx2 for cells cultured on a non-modified PEEK biomaterial (control) and on a PEEK biomaterial covalently modified according to the present disclosure, ($P<0.001$).

Finally, it was verified that the osteoblast progenitors were transformed into mature osteoblasts when cultured on the covalently modified PEEK biomaterials by analyzing the expression of the osteogenic biomarker Runx2, also called Cbfa-1. An increase in the Runx2 gene expression after 24 hours of culture (FIG. 5) was observed in comparison to non-modified conventional PEEK biomaterials by using Quantitative Real Time Polymerase Chain Reaction as described in the Methods section.

Example 7: Non-Covalent Depositing of GFR-Binding Compounds as Defined Herein

Figure 6:
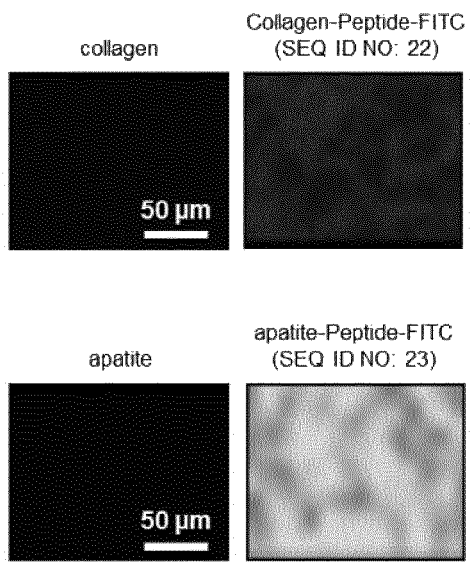
FIG. 6 is a representation of a fluorescence intensity of osteogenic GFR-binding compounds as described herein mixed with type-I collagen or with apatite ceramics substrates. The images represent surfaces non-covalently coated with osteogenic GFR-binding compounds as described herein-FITC.
Figure 7:
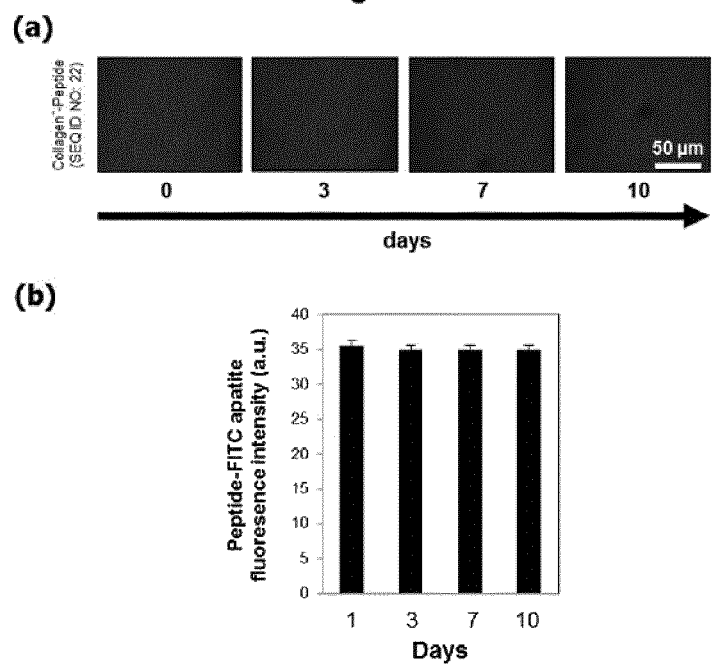
FIG. 7 is a representation of a fluorescence intensity of osteogenic GFR-binding compounds as described herein mixed with a type-I collagen substrate after 3, 7 and 10 days (a). The images represent surfaces non-covalently coated with osteogenic GFR-binding compounds as described herein-FITC. (b) is fluorescence intensity of osteogenic GFR-binding compounds-FITC coated on apatite ceramics after incubation in cell culture medium for the indicated times (up to 10 days).

Non-covalent modifications of the materials were performed in Air Atmosphere at room temperature. The non-covalent coating strategy consisted in using a mixture of inducing peptide (SEQ ID NO: 23; concentration of $1\times10^{-3}$M) with an apatite ceramics implant or a mixture of inducing peptide (SEQ ID NO: 22; concentration of $1\times10^{-3}$M) with a type-I collagen sponge. The non-covalently coated conventional materials were characterized by using fluorescent peptides (Here SEQ ID NO: 22 and 23 covalently bound to fluorescein isothiocyanate (FITC), FIG. 6). The results shown here in FIG. 6 were obtained from experiments performed with apatite ceramics and a type-I collagen sponge. It can be seen that the interaction between these peptides and the apatite ceramics or the type-I collagen is stable as no significant release of peptides was observed over time. Indeed, after 3, 7 or 10 days, the osteogenic peptides were still coupled to the ceramics or the type-I collagen (FIGS. 7a and b).

Peptides that were non-covalently deposited through specific peptide fragments (such as WWFWG or GTPGP) added to GFR-binding compounds of the invention are as follows:

| | |
|---|---|
| SEQ ID NO: 22 | WWFWGSAGPSSTPTKMSAISMLYL |
| SEQ ID NO: 23 | GTPGPHVTKPTSVPTKLSAISMLYL |
| SEQ ID NO: 24 | GTPGPVPQELEPLTILYY |
| SEQ ID NO: 25 | GTPGPVPTELSPISVLYK |
| SEQ ID NO: 26 | GTPGPASSVPTKLSAISMLYL |
| SEQ ID NO: 27 | GTPGPVPTGQSAISMLYL |
| SEQ ID NO: 28 | GTPGPVPTEESAISMLYL |
| SEQ ID NO: 29 | GTPGPPTSVPTKLSPISVLYK |
| SEQ ID NO: 30 | GTPGPPSSVPTKLSPISVLYK |
| SEQ ID NO: 31 | GTPGPNDEGLESAPTGQNAISVLYF |
| SEQ ID NO: 32 | WWFWGAAPASSSVPTRLSPISVLYK |
| SEQ ID NO: 33 | WWFWGKASKASSVPTKLSAISMLYL |
| SEQ ID NO: 34 | GTPGPGSAGPSSTPTKMSAISMLYL |
| SEQ ID NO: 35 | GTPGPAAPASSSVPARLSAISMLYL |

Example 8: Proliferation of Progenitor Bone Cells

Figure 8:
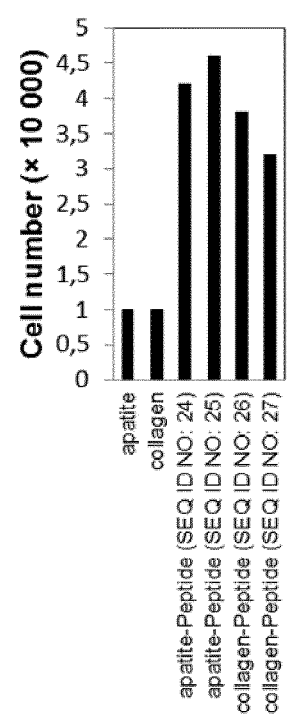
FIG. 8 is a graph representing the quantification of the proliferation of osteoblast precursors after 48 hours of cell culture on apatite ceramics and on collagen coated with osteogenic GFR-binding compounds as described herein.

The effect of the GFR-binding compounds as defined herein (SEQ ID NO: 24 to 27) of the present invention on the proliferation of osteoblast progenitors was investigated. MC3T3-E1 cells were cultured in Alpha-MEM medium supplemented with 10% fetal calf serum (FCS) and 1% penicillin/streptomycin. All the cells were used at a low passage number (passage 4), were subconfluently cultured and were plated at 10 000 cells/cm² for the purpose of the experiments. The stimulatory effect of the osteogenic peptides, coupled to apatite ceramics or to type-I collagen on osteoblast progenitor cells, was compared to the effect of native apatite ceramics or of native type-I collagen sponge, which are already being used as bone graft/LT-Cage® lumbar tapered fusion devices designed to aid in the treatment of the degenerative disc disease (DDD) in humans. The AlamarBlue® assay was used to compare cell proliferation on the different biomaterials based on detection of metabolic activity. Analysis of these data showed that the cell proliferation proceeded more significantly on apatite ceramics and type-I collagen sponge when coupled to osteogenic peptides as compared to native apatite ceramics and native type-I collagen sponge (FIG. 8).

Example 9: Osteogenic Differentiation of Human Mesenchymal Stem Cells

GFR-binding compounds as defined herein were non-covalently deposited on apatite ceramics or type-I collagen onto apatite ceramics or onto type-I collagen sponge. Human Mesenchymal Stem Cells (hMSCs) were obtained from Lonza®, Inc. Cells were then cultured in low glucose Dulbecco's Modified Eagle Medium (DMEM, Invitrogen®) supplemented with 10% (v/v) fetal bovine serum (FBS), 1% penicillin/streptomycin and incubated in a humidified atmosphere containing 5% (v/v) $CO_2$ at 37° C. All cell culture experiments were carried out without any serum in the medium for the first 8 hours of culture. All cells were used at a low passage number (5 passage 3), were subconfluently cultured and were seeded at 10 000 cells/cm² for the purpose of the experiments.

The cell phenotype was analyzed after 96 hours of cell culture on apatite ceramics coupled with osteogenic peptides or on a type-I collagen sponge coupled with osteogenic peptides (SEQ: ID NO: 28 to 31). On GFR-binding compounds as defined herein-coupled apatite ceramics and type-I collagen sponge, the vast majority of the human bone marrow mesenchymal stem cells adhere, spread, and differentiate into osteoblast-like cells as confirmed by analysis of Runx2 and Osterix expression (FIG. 9a). To probe this lineage specification, immunostaining for Runx2 and Osterix was performed after cell fixation as described in the Methods section. The quantification of Runx2 and Osterix positive contact numbers and areas was performed as described in the Methods section.

Finally, it was verified that the hMSCs were differentiated into mature osteoblasts by analyzing the activity of the osteogenic biomarker ALP (Alkaline Phosphatase Activity). We observed an increase in the ALP activity after 1 week of culture on type-I collagen sponge coupled with GFR-binding compounds as defined herein (SEQ ID NO: 32) (FIG. 9b).

Example 10: Osteogenic Differentiation of Osteoblast Progenitors

Mature osteoblasts are the cells responsible for bone formation and are derived from precursor osteoblasts. Mature osteoblasts were obtained and characterized by the expression of osteoblastic markers such as Runx2 and the synthesis of extracellular matrix proteins.

The effect of these GFR-binding compounds as defined herein (SEQ ID NO: 33) on the differentiation of osteoblast progenitors was evaluated. These osteoblast progenitors were seeded onto the apatite ceramics or on type-I collagen sponge that were both coupled with osteogenic peptides. The cells were differentiated into mature osteoblasts after 48 hours of culture on these non-covalently coated materials. The differentiated osteoblast progenitors produced extensive amounts of extracellular matrix proteins such as Osteopontin (OPN) as compared to the osteoblast precursors cultured on a native type-I collagen sponge. This was seen from Osteopontin immunofluorescence staining after cell fixation as described in the Methods section (FIG. 10).

Figure 11:
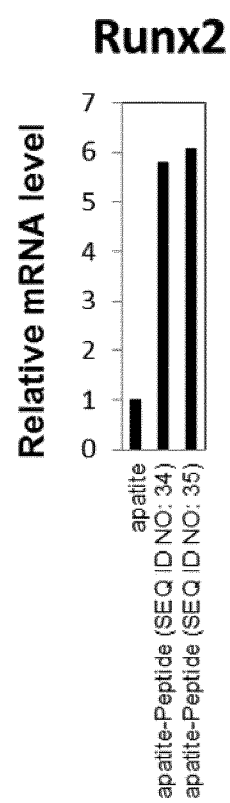
FIG. 11 is a representation of a Quantitative Real Time PCR analysis of the expression of Runx2 in cells cultured on native type-I collagen and on native type-I collagen scaffold non-covalently modified with various osteogenic GFR-binding compounds as described herein, ($P<0.005$).

Finally, it was verified that the osteoblast progenitors were differentiated into mature osteoblasts by analyzing the expression of the osteogenic biomarker Runx2. An increase in the Runx2 gene expression after 24 hours of culture (FIG. 11) was observed by using Quantitative Real Time Polymerase Chain Reaction as described in the Methods section.

Figure 12:
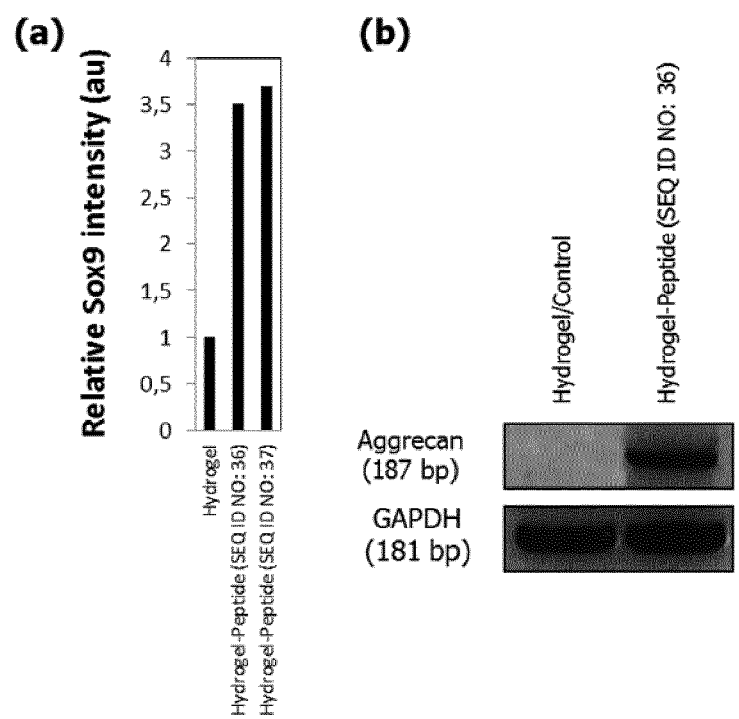
FIG. 12 is (a) a representation of a quantification of the cell area of hMSCs cultured on a native hydrogel (control) and on a hydrogel covalently modified with chondrocyte GFR-binding compounds as described herein. hMSCs commitment towards chondrocyte differentiation was observed using Sox9 (Transcription factor) immunofluorescent staining. (b) is a representation of a Quantitative Real Time PCR analysis of the expression of the Sox9 gene and a semi-quantitative RT-PCR analysis for the expression of the Aggrecan gene.

Example 11: GFR-Binding Compounds as Defined Herein Inducing Cartilage Regeneration hMSCs were cultured on native hydrogels ((poly(acrylamide-co-acrylic acid)) having a stiffness of 14 kPa and on hydrogels (also at a stiffness of 14 kPa) covalently modified with GFR-binding compounds as defined herein (SEQ ID NO: 36 and 37). The expression of the Sox9 protein was observed after 96 hours of culture suggesting that hMSCs have committed towards chondrocyte like cell differentiation (FIG. 12a). It was then verified that these hMSCs cultured on the covalently modified hydrogels were differentiated into chondrocyte cells by analyzing the expression of the chondrocyte gene biomarker: Aggrecan. The increased expression of this gene was observed after 96 hours of culture (FIG. 12b). For that a semi-quantitative RT-PCR was performed as described in the Methods section for the Aggrecan gene and a Quantitative Real Time PCR for Sox9.

Example 12: GFR-Binding Compounds as Defined Herein Inducing Endothelialization

Figure 13:
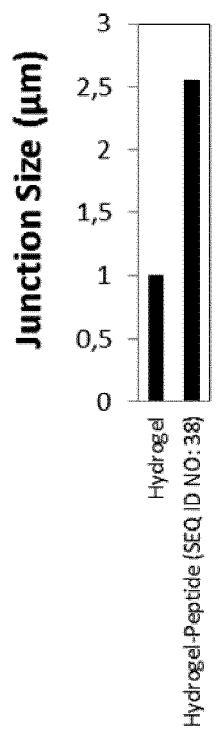
FIG. 13 is a histogram showing the distribution of the endothelial cell adherens junctions size. The results were obtained from immunofluorescence staining with an antibody against CD31 (PECAM1).

Human umbilical-vein endothelial cells were cultured on a native polymer (PET) and on a polymer (PET) covalently modified with endothelialization GFR-binding compounds as defined herein (SEQ ID NO: 38). An increase in the area of the adherent junctions (CD31) was observed after 36 hours of culture on the covalently modified PET (FIG. 13). The results observed showed that the GFR-binding compounds as defined herein have the ability to rapidly induce stent endothelialization.

Example 13: GFR-Binding Compounds as Defined Herein Inducing Angiogenesis

Figure 14:
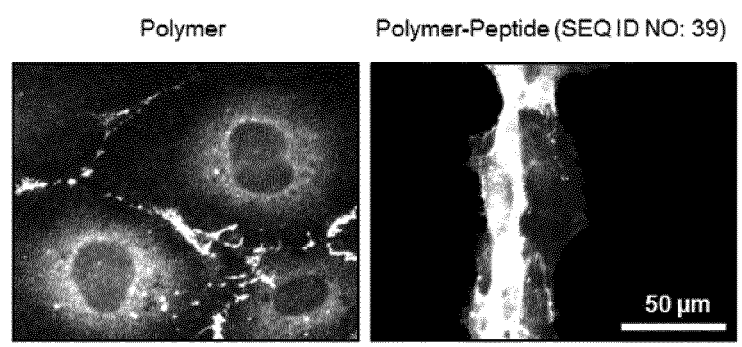
FIG. 14 is confocal images of endothelial cells (ECs) cultured on native polymer and covalently modified polymer. The fluorescence intensities corresponding to CMFDA was represented in gray.

Human umbilical-vein endothelial cells were cultured on a native polymer (PET) and on a polymer (PET) covalently modified with vascular peptides (SEQ ID NO: 39). The formation of tube-like structures was observed after 18 hours of culture on the covalently modified PET (FIG. 14). The results observed showed that the GFR-binding compounds as defined herein have the ability to rapidly induce angiogenesis.

Example 14: Wound Healing/Increase of Collective Cell Migration

Human epithelial cells were cultured on a native polymer (PET) and on a polymer (PET) covalently modified with tissue-closure peptides (SEQ ID NO: 40). A usual scratch test was applied (Nat Protoc 2: 329-333) on a monolayer of these epithelial cells in culture (FIG. 15a). An increase in the cell migration velocity for cells cultured on PET covalently modified with peptides was observed after 18 hours of culture. The cells migrated collectively and the communication between cells was maintained (FIG. 15b). In fact, the injury has been closed rapidly for the cells cultured on polymers covalently modified with GFR-binding compounds as defined herein. The results observed showed that the GFR-binding compounds as defined herein have the ability to rapidly induce tissue closure such as in wound healing.

Example 15: Loss of Quiescence and Activation of Hair Follicle Stem Cells

Figure 16:
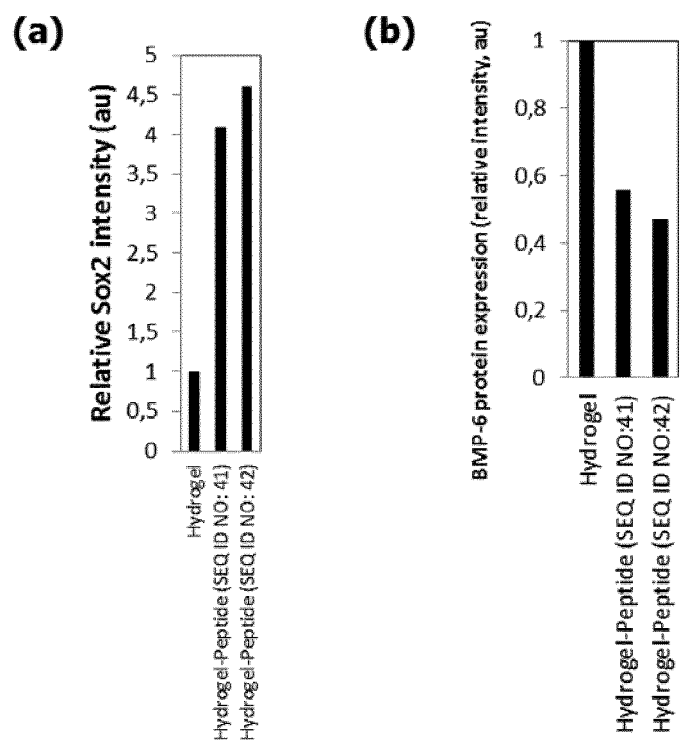
FIG. 16 is (a) a diagram representing the results of a Quantitative Real Time PCR analysis for the expression of Sox2 in cells cultured on the native hydrogel (control) and on the hydrogel covalently modified with Hair Follicle Stem Cell activation compounds of invention. (b) The total BMP-6 immunofluorescence intensity in the cell culture medium was quantified for Hair Follicle Stem Cells cultured for 96 h.

Isolated Hair Follicle Stem Cells were cultured on native hydrogels ((poly(acrylamide-co-acrylic acid)) having a stiffness of 73 kPa and hydrogels (also at a stiffness of 73 kPa) covalently modified with hair follicle stem cells GFR-binding compounds as defined herein (SEQ ID NO: 41 and 42). An increase in the Sox2 protein expression was observed indicative of the activation of these stem cells (FIG. 16a). In parallel, a decrease in the BMP-6 release in the cell culture medium was observed (FIG. 16b). The decrease in the BMP-6 release is indicating that the hair follicle stem cells were activated and that the hair growth process has been induced.

Figure 17:
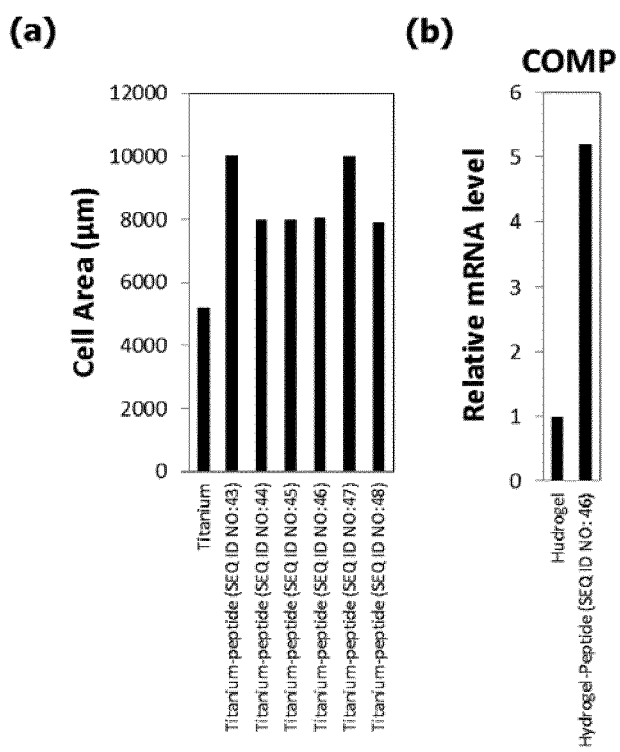
FIG. 17 is (a) a quantification of the cell area of hMSCs cultured on native hydrogel (control) and on hydrogel covalently modified with musculogenic GFR-binding compounds as described herein. The average cell area was estimated from approximately 25 cells from 2 different passages. (b) is a Quantitative Real Time PCR analysis for the expression of the COMP gene (Cartilage Oligomeric Matrix Protein, a tendon/ligament lineage gene).

Example 16: Muscle Differentiation of Human Mesenchymal Stem Cells hMSCs were cultured on native hydrogels ((poly(acrylamide-co-acrylic acid)) having a stiffness of 28 kPa and on hydrogels (having the same stiffness of 28 kPa) covalently modified with musculogenic peptides (SEQ ID NO: 43 to 48). We observed an increase in the cell area of the cells cultured on the covalently modified hydrogels after 62 hours of culture suggesting that hMSCs have committed towards muscle differentiation (FIG. 17a).

It was then verified that these hMSCs cultured on the covalently modified hydrogels were differentiated into muscle cells by analyzing the expression of the musculogenic biomarker COMP (Cartilage Oligomeric Matrix Protein). An increased expression of this gene was observed after 96 hours of culture (FIG. 17b). For that a Quantitative Real Time PCR was performed as described in the Methods section.

Example 17: Neuron Growth

Figure 18:
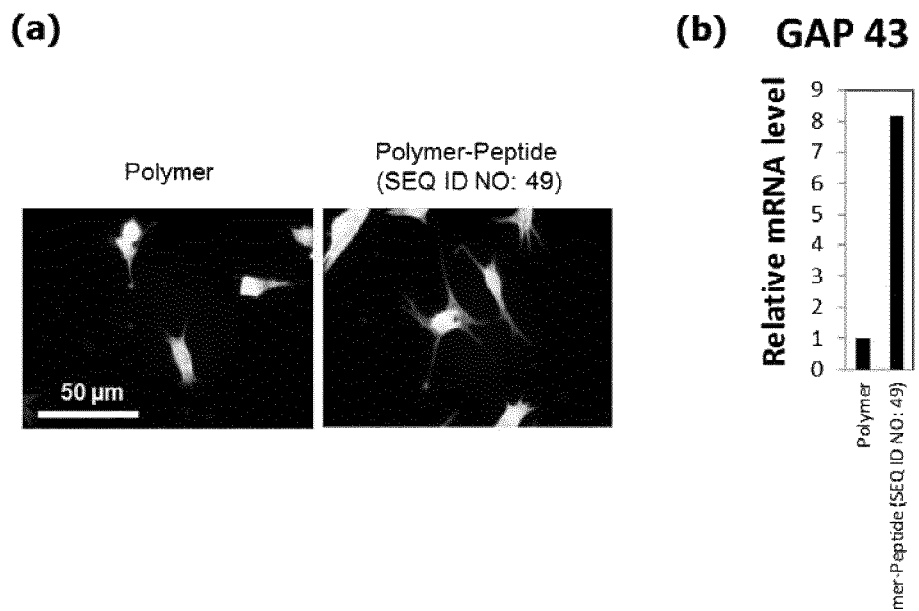
FIG. 18 is (a) Representative images of neurons cultured on a native polymer and on a covalently modified polymer. Phalloidin and vinculin immunostainings are represented in green and red, respectively. The nucleus was stained with DAPI and is represented in blue. (b) is a diagram representing the results of a Quantitative Real Time PCR analysis of the expression of the Growth Associated Protein 43 (GAP43) gene in cells cultured on the native polymer (PET, control) and on the polymer (PET) covalently modified with neurogenic peptides.

Neurons were cultured on native titanium (control) and on titanium covalently modified with neurogenic peptides (SEQ ID NO: 49). A rapid establishment of cell-cell contacts via dendrite growth was observed after 6 hours of culture on the covalently modified titanium (FIG. 18a). This result suggests that the activity of the used neurogenic peptides is to promote the neuron-neuron contacts. To further confirm this the expression of the Growth Associated Protein 43 (GAP43) gene was verified for neuron cells cultured on materials covalently modified with neurogenic peptides (SEQ ID NO: 49). A high level of expression of this gene was observed after 48 hours of culture on the covalently modified titanium by using Quantitative Real Time Polymerase Chain Reaction as described in the Methods section (FIG. 18b).

Figure 19:
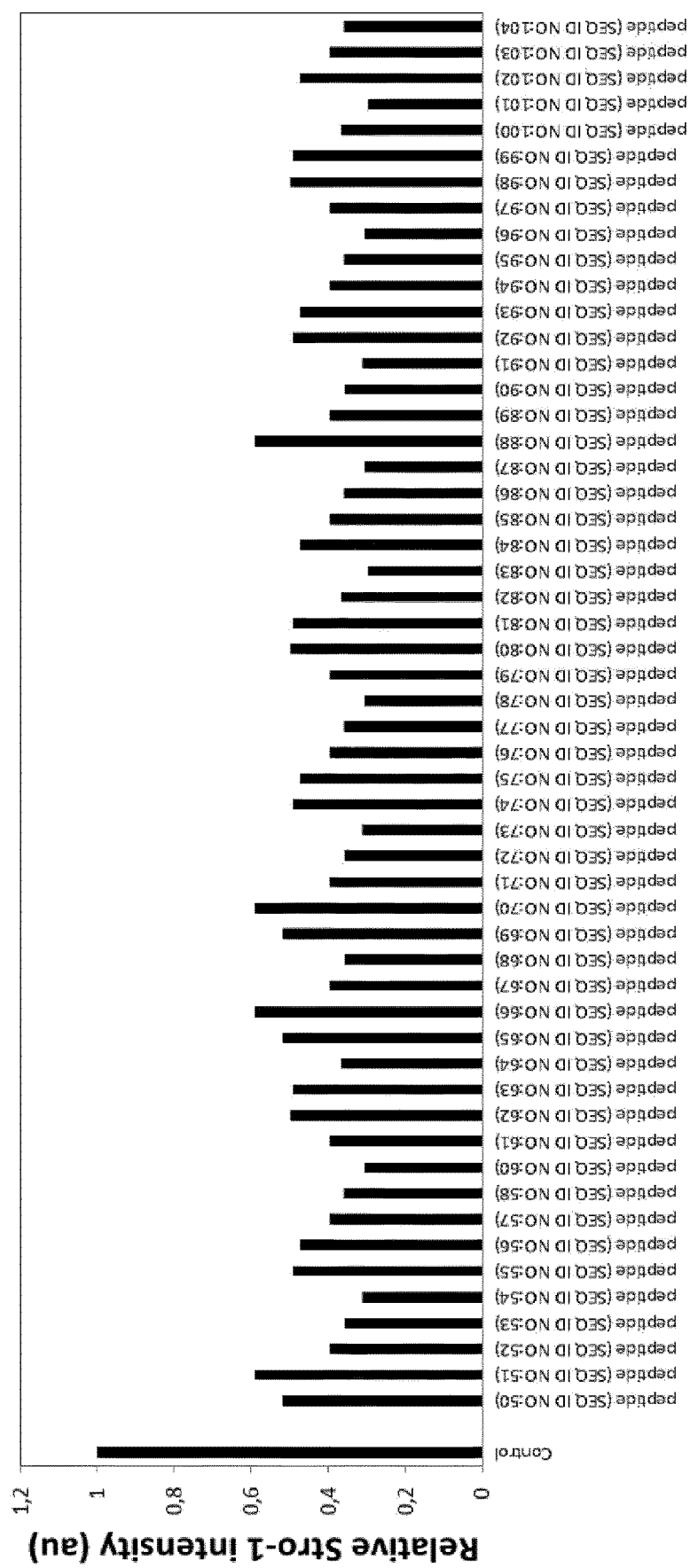
FIG. 19 is a representation representing the amount of STRO-1 (a hMSC stemness marker) present in the cells expressed as an average fluorescence intensity, normalized by the number of cells.

Example 18: Loss of Stemness hMSCs were cultured on conventional cell culture plastic plates with or without the presence in the cell culture media of different GFR-binding compounds as defined hereins (SEQ ID NO: 50 to 104) in solution. A rapid (48 hours) loss of the stemness marker STRO-1 was observed for the cells cultured in the presence of GFR-binding compounds as defined herein in the cell media solution (FIG. 19). This was probed by Stro-1 immunostaining after cell fixation as described in the Methods section. The quantification of Stro-1 positive contact numbers and areas was performed as described in the Methods section. A minimum of 30 cells per condition were analyzed. All the sequences have an RMSD of 2.45 Å or less as shown in table 4.

TABLE 4

| SEQ ID NO: | Sequences | RMSD (Å) |
|---|---|---|
| SEQ ID NO: 50 | ASAAPSSVPQALRPVQVRKI | 0.79 |
| SEQ ID NO: 51 | ASPSSVSQDLRPVQVRKI | 0.91 |
| SEQ ID NO: 52 | ASASPSSVPQDLRPVQVRKI | 0.88 |
| SEQ ID NO: 53 | NDEGLESVPTEERPVQVRKI | 0.71 |
| SEQ ID NO: 54 | RPVQVRKI | 0.62 |
| SEQ ID NO: 55 | TVPKPSSVPTQLSNITMQIM | 1.1 |
| SEQ ID NO: 56 | AVPKASSVPTKLSNITMQIM | 1.12 |
| SEQ ID NO: 57 | SIPKASSTPTELSPINMLYF | 0.73 |
| SEQ ID NO: 58 | TKPTSTPTKLSPINMLYF | 0.96 |

TABLE 4-continued

| SEQ ID NO: | Sequences | RMSD (Å) |
|---|---|---|
| SEQ ID NO: 59 | YVPKPSSTPTKLSPINMLYF | 0.77 |
| SEQ ID NO: 60 | ASAAPSSVPQALSSLSILFF | 0.81 |
| SEQ ID NO: 61 | ASASPSSVSQDLSSLSILFF | 0.79 |
| SEQ ID NO: 62 | VVPKPSSAPTQLEPISILYL | 0.72 |
| SEQ ID NO: 63 | AVPKASSAPTKLEPISILYL | 0.79 |
| SEQ ID NO: 64 | KVGKASSVPTKLEPISILYL | 0.79 |
| SEQ ID NO: 65 | SSVKSQPSRVHHKPLSMLYV | 0.71 |
| SEQ ID NO: 66 | RNVQSRPTQVQLKPLSMLYV | 0.79 |
| SEQ ID NO: 67 | KIPKASSVPQELEPLPIVYY | 0.84 |
| SEQ ID NO: 68 | GIPEPSSVPQKMEPLPIVYY | 0.85 |
| SEQ ID NO: 69 | SIPKASSVPQELEPLPIVYY | 0.82 |
| SEQ ID NO: 70 | ASAAPSSVPQALEPLTILYY | 0.87 |
| SEQ ID NO: 71 | ASASPSSVSQDLEPLTILYY | 0.91 |
| SEQ ID NO: 72 | NDEGLESVPTEEEPLTILYY | 0.83 |
| SEQ ID NO: 73 | NDEGLESVPTEESSLSILFF | 0.56 |
| SEQ ID NO: 74 | KASKASSVPTKLSNITMQIM | 1.43 |
| SEQ ID NO: 75 | GSAGPSSTPTKMSNITMQIM | 1.52 |
| SEQ ID NO: 76 | AAPASSSVPARLSNITMQIM | 1.44 |
| SEQ ID NO: 77 | RVPSTSSAPTKTSATSVLYY | 0.87 |
| SEQ ID NO: 78 | ASAAPSSAPTALSATSVLYY | 0.84 |
| SEQ ID NO: 79 | ASASPSSAPTDLSATSVLYY | 0.81 |
| SEQ ID NO: 80 | SIPKASSVPTELRSVKVAKV | 1.23 |
| SEQ ID NO: 81 | HVTKPTSAPTKLRSVKVAKV | 1.21 |
| SEQ ID NO: 82 | TVPKPSSAPTQLRSVKVAKV | 1.11 |
| SEQ ID NO: 83 | KVGKASSVPQKLEPLPIVYY | 1.1 |
| SEQ ID NO: 84 | KASKASSVPQKLEPLPIVYY | 0.77 |
| SEQ ID NO: 85 | RNVQSRPVPTQLSPISVLYK | 1.42 |
| SEQ ID NO: 86 | KIPKASSVPTELSPISVLYK | 1.35 |
| SEQ ID NO: 87 | ASAAPSSVPQALRSVKVAKV | 1.27 |
| SEQ ID NO: 88 | VSQDLRSVKVAKV | 0.96 |
| SEQ ID NO: 89 | ASASPSSVPQDLRSVKVAKV | 1.42 |
| SEQ ID NO: 90 | NDEGLESVPTEERSVKVAKV | 1.45 |
| SEQ ID NO: 91 | TQVKMRPVQVRKI | 0.99 |
| SEQ ID NO: 92 | SIPKASSTQVELRPVQVRKI | 0.97 |
| SEQ ID NO: 93 | KIPKASSTPTELSPINMLYF | 1.13 |
| SEQ ID NO: 94 | GIPEPSSTPTKMSPINMLYF | 1.31 |
| SEQ ID NO: 95 | VPTGQSAISMLYL | 1.23 |
| SEQ ID NO: 96 | NDEGLESVPTEESAISMLYL | 0.96 |
| SEQ ID NO: 97 | NDEGLESVPTEESPISILYI | 0.92 |
| SEQ ID NO: 98 | VVVKSQPSRVHHSPISILYI | 0.79 |
| SEQ ID NO: 99 | SSVKSQPSRVHHSPISILFI | 0.79 |
| SEQ ID NO: 100 | RNVQSRPTQVQLSPISILFI | 0.79 |
| SEQ ID NO: 101 | YVPKPSSAPTKLNAISVLYF | 0.71 |
| SEQ ID NO: 102 | RVPSTSSVPTKTSAISMLYL | 0.67 |
| SEQ ID NO: 103 | HVPKPSSAPTKLEPISILYL | 0.66 |
| SEQ ID NO: 104 | RVPSTSSAPVKTEPISILYL | 0.87 |

Example 19: Differentiation of Human Hematopoietic Stem Cells hMSCs were cultured on conventional cell culture plastic plates with or without the presence in the cell culture media of different GFR-binding peptides as described herein (SEQ ID NO: 1071 to 1085) grafted on a PET surface via the method already described above. A rapid (48 hours) loss of the stemness marker CD-34+ was observed for the cells cultured in the presence of GFR-binding peptides as described herein in the cell media solution. This was probed by CD-34+ immunostaining after cell fixation as described in the Methods section. The quantification of CD-34+ positive contact numbers and areas was performed as described in the Methods section. A minimum of 30 cells per condition were analyzed. CD-34+ positive marrow cells are multipotential and capable of differentiating into all the various blood cell types. All the sequences have a RMSD of 2.45 Å or less as defined herein and as shown in table 5.

TABLE 5

| SEQ ID NO: | Sequences | RMSD Å | CD34+ Expression (%) |
|---|---|---|---|
| 1071 | RVPSTSSVPTELSAISVLYL | 1.23 | 29 |
| 1072 | RVPSTSSVPTDLSSLSILFF | 1.01 | 26 |
| 1073 | AASKASSVPQQLSSLSTLFF | 1.02 | 29 |
| 1074 | RVPSTSSVPQQLNAISTLYF | 1.09 | 32 |
| 1075 | AASKASSSRVEESATSTLYY | 0.98 | 28 |
| 1076 | RVPSTSSAPVEESPISTLYI | 0.74 | 27 |
| 1077 | RVPSTSSTQVRLSPISMLFI | 0.82 | 24 |
| 1078 | AASKASSVPTKMEPISTLYL | 0.97 | 30 |
| 1079 | AASKASSAPTKMSPINILYF | 1.01 | 30 |
| 1080 | RVPSTSSTPTKMKPLSILYV | 1.1 | 31 |
| 1081 | KIPKASSVPEELEPLPTVYY | 1.22 | 33 |
| 1082 | KIPKASSTPTGQSNITMQIM | 1.32 | 18 |
| 1083 | KIPKASSTPTRLRSVKMAKV | 1.17 | 17 |
| 1084 | KIPKASSVPTKMRPVQMRKI | 1.18 | 18 |
| 1085 | AASKASSVPAKMRPVQTRKI | 1.23 | 19 |

Example 20: RMSD Measurement and Biological Activity

RMSD values are always calculated for a GFR-binding peptide sequence exempt from any bioactive-carrier-affinity-containing group as defined herein (e.g. cysteine, WWFWG, GTPGP, etc. . . . ). When needed i.e. when attachment to a bioactive carrier is contemplated, the bioactive-carrier-affinity-containing group is then present in the GFR-binding compound when it is biologically tested. Using the method detailed in the description, the RMSD of 57 previously reported peptide sequences have been determined (Table 6) and correlated with the expression of STRO-1 after grafted on a PET surface via a procedure as already described above. These data show that a calculated value of RMSD of more than 2.45 Å, in particular more than 2 Å, more particularly more than 1.79 Å, always correlates with no significant hMSCs commitment and/or differentiation of the treated cells. One should note that it is commonly admitted that the expression of STRO-1 in a cell is indicative of a cell that is in a substantially non-differentiated state and the decrease of its expression of at least about 20% is indicative of a cell that has started a processes of differentiation but which may not result in the differentiation of the cell. A decrease of more than 50% would be indicative of the presence of a significant shift towards a differentiated state. A decrease of more than 70% would be indicative of the presence of a very important shift towards a differentiated state. A sustained decrease (e.g. for at least 96 h) of more than 50% or 70% would be indicative of the presence of an even more important shift towards a differentiated state.

TABLE 6

| SEQ ID NO: | Sequences | RMSD (Å) | STRO-1 expression (%) |
|---|---|---|---|
| 1086 | VEQLSNMVVK | 5.2 | 98 |
| 1087 | PIIYYVGRNVRVEQLSNMVVRA | 5.7 | 92 |
| 1088 | PIIYYVGRNVRVEQLSNMVVRRA | 6.1 | 98 |
| 1089 | DPLPIIYYVGRNVRVEQLSNMVVRACKCS | 4.9 | 97 |
| 1090 | ENVNLKKYRNMIVKSCGCH | 7.3 | 97 |
| 1091 | TPTYSRPVQKAELTR | 6.3 | 97 |
| 1092 | HIRSTTSSYVSLKSNITNRTIQTPTYSYT | 8.1 | 98 |
| 1093 | LMDLARMPSCLRGERAVPQDTTGYFTWSSNITPLNFIF | 8.6 | 92 |
| 1094 | NEVLRFCGIQVPEGDEPLT | 6.7 | 98 |
| 1095 | LNEVLRFCGIQVPEGDEPLTY | 6.8 | 99 |
| 1096 | MSRVLFEPLTFLQTGSGLPDEKTLG | 5.9 | 94 |
| 1097 | IKSPARHSAPTHQEPLP | 4.5 | 98 |
| 1098 | NPGASASPCCVSQDLEPLPIL | 5.3 | 86 |
| 1099 | SHQSAGDSIKSPARHSAPTHQEPLPD | 6.4 | 91 |
| 1100 | PNYSVPAGNKPLSERE | 6.8 | 95 |
| 1101 | TKPLSSLLFPNWNTTTTPTPPRP | 7.1 | 91 |
| 1102 | CVTKPLSSLLFPNWNTTTTPTPP | 7 | 92 |
| 1103 | VGAAWWLREQGSPINTLAVPA | 5.9 | 88 |
| 1104 | MQCRELVTQVTEEPISQTEDGEEQESTTTPRLKGQKKE | 4.3 | 85 |
| 1105 | VPTKLEPISVLYKDDMGVPTLKYHYEGMAVSECGCR | 4.2 | 81 |
| 1106 | SPISILVVPELDASLPEKRPSLDGFEALLVYNAPKA | 5.5 | 82 |
| 1107 | TLXPIVSSXNPSPISFRXIKILLHDLEVVPFPKSRVR | 4.8 | 84 |
| 1108 | VPTKLSPISILYLDKGVVTYKFKYEGMSVAECGCR | 4.1 | 80 |
| 1109 | VPTKLSPISILYKDDMGVPTYKFKYEGMSVAECGCR | 4 | 82 |
| 1110 | VPTELSPISLLYLDEFEKVTLKNYQDMVVDG | 3.7 | 87 |
| 1111 | TPTVVSATSL | 3.6 | 98 |
| 1112 | SATSRLALSDVPAELAA | 5.2 | 98 |
| 1113 | LGIAAIIFLQQVPAAFSATSPPG | 5.7 | 97 |

TABLE 6-continued

| SEQ ID NO: | Sequences | RMSD (Å) | STRO-1 expression (%) |
|---|---|---|---|
| 1114 | SVPAVCSATSATGPYSSVTVTSWPSIVATGGTT | 4.5 | 92 |
| 1115 | SVPAVCSATSATGPYSTATNTVVVPSIVATGGTT | 5.2 | 92 |
| 1116 | SSVPAVCSATSATGPYSSGSVEVTFDVYATTVY | 5.1 | 92 |
| 1117 | SSVPAVCSATSATGPYSTATNTVVVFDVYATTVY | 4.7 | 91 |
| 1118 | VHLLKPHAVPKACCAPTKLSATSVLYYDSSNNVILRKHRNMVVRACGCH | 3.8 | 88 |
| 1119 | ANINKDRDNVPAATSSLSKAYNP | 6.2 | 92 |
| 1120 | SFRTARANAPTGRSSLSGEKEQQEASTHS | 5.4 | 91 |
| 1121 | DKPEESSSTPTHAQCICSSLSEAIVSSVLSTRLVLSQISLTRAKRAFE | 4.8 | 87 |
| 1122 | KGSEYEKLVVSGITQVYQSSLSWHGCKSCCEVQVXNLXILIRLYDVHYYN | 4.1 | 88 |
| 1123 | MALPQPRGSSLSKAPVVVAPCMALKRVNIRSIVFEVLKTMNQNCIHETPN | 4.7 | 82 |
| 1124 | MAAQDEWRDAITLTMGRDLKKVPQHLNAISVIDPVT | 7 | 83 |
| 1125 | LSLLAPPEPVWNHETSYGSDCHVPTNVNAISKMIDKSNHQTG | 4.3 | 93 |
| 1126 | APTKLNAISVLYFDDSSNVILKKYRNMIVKS | 5.8 | 84 |
| 1127 | APTQLSAISVL | 2.9 | 93 |
| 1128 | FDSRVLKSAISFKENIIF | 2.8 | 89 |
| 1129 | KIPKPSSAPTELSAISMC | 3.3 | 78 |
| 1130 | CPKPSSAPTELSAISMLL | 3.6 | 79 |
| 1131 | TCCVPELSAISMLYLDEN | 4.7 | 84 |
| 1132 | KIPKPSSAPTELSAISMLC | 3.6 | 82 |
| 1133 | KIPKPSSAPTELSAISMLYC | 3.6 | 80 |
| 1134 | CIPKPSSAPTELSAISMLYL | 3.6 | 83 |
| 1135 | CKIPKPSSAPTELSAISMLYL | 3.5 | 78 |
| 1136 | AETLHTLGLSAPVIESAISDAI | 4.6 | 93 |
| 1137 | MRTESTPTTASAISYECLWSPPSNEAAKLHFDS | 6.1 | 94 |
| 1138 | SRVLPIVVQGYVPVQDTKFLGIYYVIGPIIARVILSSSSAISSLNKS | 4.7 | 84 |
| 1139 | CCAPTELSAISVLYFDDSSNVILKKYRNMVVRACGCR | 3.4 | 81 |
| 1140 | CCAPTQLSAISVLYFDDSSNVILKKYRNMVVRACGCR | 3.2 | 82 |
| 1141 | KPCCAPTQLSAISVLYFDDSSNVILKKYRNMVVRACGCR | 3.6 | 80 |
| 1142 | KPCCAPTELSAISVLYFDDSSNVILKKYRNMVVRACGCR | 3.3 | 83 |

Likewise, using the method detailed in the description, the RMSD of 87 GFR-binding peptide sequence representatives of the invention have been determined (Table 7) and correlated with the expression of STRO-1 after grafted on a PET surface via a procedure as already described above. SEQ ID NO: 1 to 49 were tested in combination with a bioactive carrier as defined above in the Examples Section (i.e. titanium, ceramics, PEEK, hydrogel, etc. . . . ), whereas SEQ ID NO: 1143 to 1180 were tested in solution. These data show that a calculated value of RMSD of 2.45 Å or less, in particular 2 Å or less, more particularly 1.79 Å or less, always correlates with a significant hMSCs commitment and/or differentiation of the treated cells.

TABLE 7

| SEQ ID NO: | Sequences | RMSD (Å) | STRO-1 expression (%) |
|---|---|---|---|
| 1 | GSAGPSSVPTKMSAISMLYL | 0.78 | 21 |
| 2 | AAPASSSVPTRLSAISMLYL | 1.02 | 18 |
| 3 | STPPTSSVPTRLSAISMLYL | 0.98 | 19 |
| 4 | NDEGLESAPTEENAISVLYF | 1.12 | 22 |
| 5 | NDEGLESAPTGQNAISVLYF | 0.77 | 27 |
| 6 | KIPKASSVPTELSATSVLYY | 0.74 | 25 |
| 7 | GIPEPSSVPEKMSATSVLYY | 0.83 | 22 |
| 8 | GSAGPSSVPTKMSPISVLYK | 1.01 | 31 |
| 9 | HVTKPTSVPEKLSSLSILFF | 0.66 | 29 |
| 10 | KVGKASSVSQKLEPLTILYY | 1.31 | 32 |
| 11 | RNVQSRPTQVQLNAISVLYF | 1.08 | 24 |
| 12 | HVPKPSSAPTKLSAISMLYL | 0.88 | 28 |
| 13 | KVGKASSVPTKLEPLTILYY | 0.72 | 26 |
| 14 | RNVQSRPTQVQLSAISMLYL | 0.68 | 16 |
| 15 | ASASPSSVSQDLSAISMLYL | 0.7 | 13 |
| 16 | HVPKPSSVPTKLSPISVLYK | 1.11 | 23 |
| 17 | NDEGLESVPTGQNAISVLYF | 1.05 | 31 |
| 18 | TVPKPSSAPTQLSAISMLYL | 0.93 | 23 |
| 19 | AVPKASSAPTKLSAISMLYL | 0.59 | 19 |
| 20 | KVGKASSVPTKLSAISMLYL | 0.64 | 19 |
| 21 | GGGKASSVPTKLSAISMLYL | 1.56 | 30 |
| 22 | WWFWGSAGPSSTPTKMSAISMLYL | 1.14 | 29 |
| 23 | GTPGPHVTKPTSVPTKLSAISMLYL | 1.02 | 28 |
| 24 | GTPGPVPQELEPLTILYY | 0.88 | 16 |
| 25 | GTPGPVPTELSPISVLYK | 0.87 | 17 |
| 26 | GTPGPASSVPTKLSAISMLYL | 0.62 | 23 |
| 27 | GTPGPVPTGQSAISMLYL | 0.7 | 24 |
| 28 | GTPGPVPTEESAISMLYL | 0.65 | 22 |
| 29 | GTPGPPTSVPTKLSPISVLYK | 0.59 | 27 |
| 30 | GTPGPPSSVPTKLSPISVLYK | 0.68 | 26 |
| 31 | GTPGPNDEGLESAPTGQNAISVLYF | 1.56 | 32 |
| 32 | WWFWGAAPASSSVPTRLSPISVLYK | 1.67 | 27 |
| 33 | WWFWGKASKASSVPTKLSAISMLYL | 0.96 | 26 |
| 34 | GTPGPGSAGPSSTPTKMSAISMLYL | 1.03 | 26 |
| 35 | GTPGPAAPASSSVPARLSAISMLYL | 1.6 | 19 |
| 36 | AVPKASSAPTKLEPLPIVYY | 0.53 | 21 |
| 37 | KIPKASSVSQELEPLTILYY | 0.87 | 17 |
| 38 | STPPTSSSRVRLRSVKVAKV | 1.81 | 34 |
| 39 | KVGKASSVPTKLSNITMQIM | 0.9 | 32 |
| 40 | ASASPSSTQVDLRPVQVRKI | 1.34 | 36 |
| 41 | AASKASSVPEKLSSLSILFF | 0.66 | 28 |
| 42 | GSAGPSSVPEKMSSLSILFF | 0.81 | 26 |
| 43 | RVPSTSSVPAKTSPISILYI | 1.01 | 15 |
| 44 | ASAAPSSVPAALSPISILYI | 1.22 | 15 |
| 45 | NDEGLESVPAEESPISILYI | 1.21 | 16 |
| 46 | VPAGQSPISILYI | 0.75 | 20 |
| 47 | NDEGLESVPAEESPISILYI | 0.86 | 18 |
| 48 | VPAEESPISILYI | 0.64 | 21 |
| 49 | GIPEPSSVPAKMSPISILYI | 1.06 | 19 |
| 1143 | NDEGLESVPEDLSSLSVLFF | 1.92 | 23 |
| 1144 | RVPSTSSVPTGQSAISTLYL | 1.78 | 19 |
| 1145 | RVPSTSSAPTKMNAISMLYF | 1.5 | 23 |
| 1146 | GIPEPSSAPTELSATSILYY | 1.66 | 20 |
| 1147 | STPPTSSVPTELSPISTLYK | 1.71 | 21 |
| 1148 | GIPEPSSAPVDLKPLSTLYV | 1.53 | 11 |
| 1149 | AASKASSVPQEEEPLPMVYY | 1.54 | 23 |
| 1150 | KIPKASSVSQKMEPLTMLYY | 1.7 | 20 |
| 1151 | KIPKASSVPTGGSNITVQIM | 1.43 | 32 |
| 1152 | AASKASSSRVELRSVKIAKV | 1.23 | 33 |
| 1153 | KIPKASSTQVRLRPVQIRKI | 1.87 | 30 |
| 1154 | STPPTSSSRVQLSAISMLYL | 1.44 | 15 |
| 1155 | RVPSTSSQVKMSAISMLYL | 0.97 | 17 |
| 1156 | GIPEPSSVSQEESSLSTLFF | 0.88 | 19 |
| 1157 | KIPKASSSRVRLSSLSTLFF | 1.32 | 20 |
| 1158 | AASKASSTPTDLNAISTLYF | 1.66 | 20 |
| 1159 | RVPSTSSTQVDLNAISVLYF | 1.84 | 23 |
| 1160 | GIPEPSSVSQELSATSMLYY | 1.49 | 22 |
| 1161 | KIPKASSTQVGQSATSILYY | 1.93 | 27 |
| 1162 | STPPTSSAPVGQSPISMLYI | 1.83 | 19 |
| 1163 | KIPKASSTPTRLSPISMLFI | 1.45 | 28 |
| 1164 | GIPEPSSAPTRLEPISMLYL | 1.56 | 16 |
| 1165 | KIPKASSVSQQLEPISTLYL | 1.57 | 17 |
| 1166 | STPPTSSVPTEVSPINTLYF | 1.78 | 19 |
| 1167 | AASKASSSRVKMSPINVLYF | 1.75 | 19 |

TABLE 7-continued

| SEQ ID NO: | Sequences | RMSD (Å) | STRO-1 expression (%) |
|---|---|---|---|
| 1168 | KIPKASSVPTKMKPLSVLYV | 1.68 | 21 |
| 1169 | RVPSTSSAPTKMKPLSMLYV | 1.48 | 22 |
| 1170 | STPPTSSVSQKMKPLSILYV | 1.46 | 25 |
| 1171 | KIPKASSVPAQLEPLPIVYY | 1.71 | 28 |
| 1172 | GIPEPSSAPVGQEPLPMVYY | 1.74 | 28 |
| 1173 | RVPSTSSVPEKMEPLTMLYY | 1.8 | 18 |
| 1174 | GIPEPSSAPVEEEPLTTLYY | 1.75 | 21 |
| 1175 | STPPTSSTPTKMSNITTQIM | 1.97 | 27 |
| 1176 | RVPSTSSVPAEESNITVQIM | 1.92 | 26 |
| 1177 | AASKASSVPQRLRSVKVAKV | 2.01 | 31 |
| 1178 | KIPKASSTQVRLRSVKTAKV | 2.04 | 35 |
| 1179 | AASKASSVPEKMRPVQTRKI | 2.14 | 32 |
| 1180 | GIPEPSSAPVDMRPVQIRKI | 2.17 | 30 |

Example 21: Application in the Treatment of Osteoporosis

The following study aims at validating the osteoinduction, osteoconducion and osteoclast inhibition activity properties of the GFR-binding compounds in a critical size fracture induced defect in an osteoporosis rat model. The goal is to induce the process of bone regeneration in a physiological way resulting in osteogenesis without bone formation anomalies like ectopic growth or osteopetrosis.

A. Osteoporosis Rat Model

Given that the acceleration of bone turnover caused by oestrogen deficiency at menopause is the most common cause of osteoporosis, animal models that lose bone in response to oestrogen deficiency are preferred in the preclinical examination of therapeutic agents. This bone loss is characterized by an increased turnover rate, decreased bone mass as measured by densitometry and decreased bone volume. The ovariectomy-induced osteoporosis (OVX) rat model is most commonly used in research on osteoporosis and in preclinical animal studies. After ovariectomy, bone resorption exceeds bone formation, causing a rapid and reproducible bone loss in response to oestrogen deficiency.

B. Experimental Protocol

Figure 21:
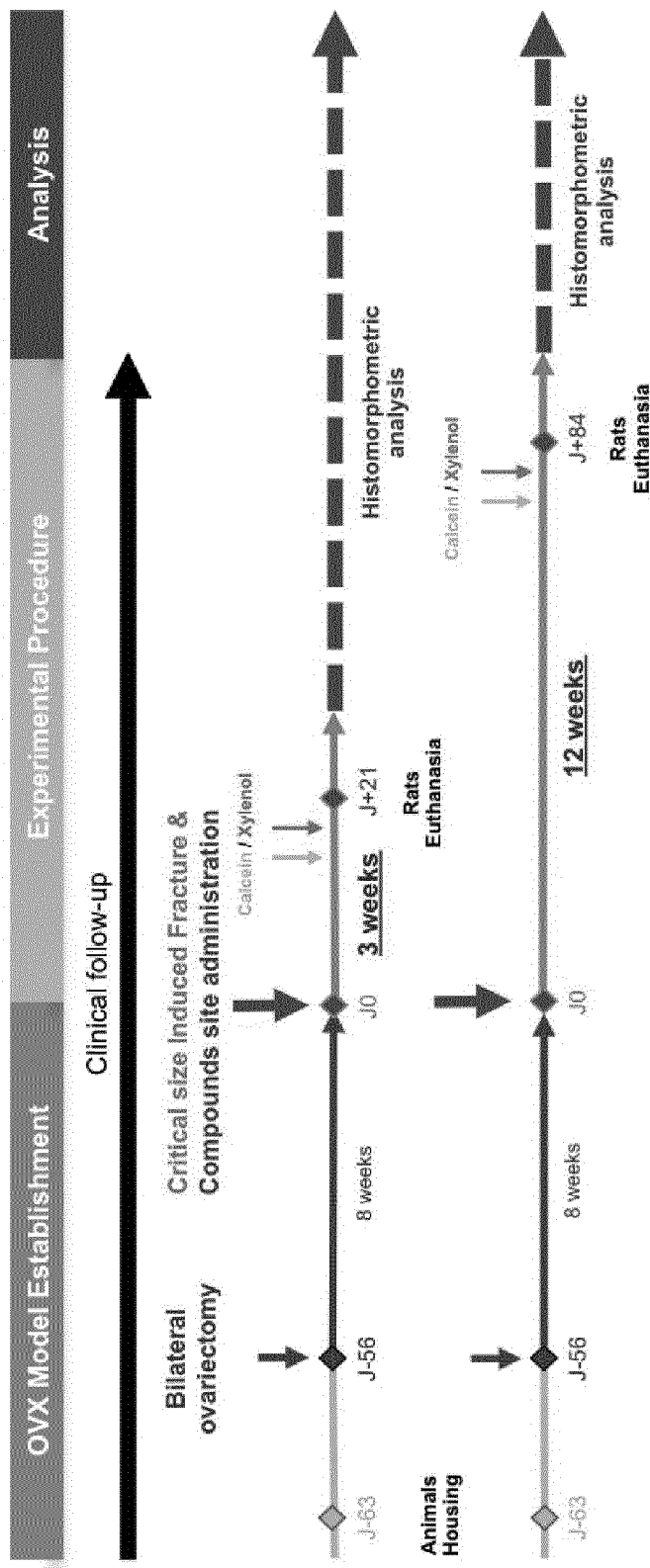
FIG. 21 is an overview of the experimental protocol used to demonstrate the effect of several embodiments according to the present disclosure on osteoporosis.

An overview of the experimental protocol is schematically represented in FIG. 21.

B.1. Surgical Procedure

After 1 week of adaptation period, 3-month-old female rats (Sprague Dawley® strain) were subjected to bilateral ovariectomy (OVX) dorsal surgery. This procedure involves pain and therefore an analgesic administration was performed 30 minutes before surgery and 6 hours after surgery. Significant bone loss in the femoral condyle due to induced estrogen deficiency is typically obtained 8 weeks after the surgery with this animal model. One week before compound administration the OVX rats were randomly assigned to three different groups.

B.2. Compound Administration

Eight weeks after the surgery, a critical size defect of 3 mm was drilled in the femoral condyle of the OVX rats at J0 and a covalently bound GFR-binding compound (SEQ ID NO: 1181) was site administrated. This critical size defect would not heal alone through complete bone formation without external intervention at the experimental endpoints of the present study: 3 weeks and 12 weeks. The control conditions include a "No implantation" condition for which no implantations were performed in the defect as well as one ceramic (70% TCP30% HA) implant: a granulated ceramic powder (Control 2). SEQ ID NO: 1181 was grafted (via covalent binding of a N-terminal cysteine using a procedure already described herein) on a granulated ceramic powder (enabling osteoconduction). Hereinafter the various experimental conditions, the results for which are detailed below:

| Experimental conditions | Code | Type of product | Reference or test product |
|---|---|---|---|
| No implantation (empty defect) | No implantation | None | Reference |
| Granulated Ceramic Powder | Control 2 | Powder | Reference |
| Granulated Ceramic powder grafted with SEQ ID NO: 1181 | HTD-PCL-M01 | Powder | Test |

Two experimental endpoints were tested in the present study: 3 weeks and 12 weeks after compound administration. The first endpoint of 3 weeks allows the detection of an early osteogenesis process involving stem cells and progenitor cells differentiation towards the osteoblast lineage. The second endpoint of 12 weeks allows the detection of osteoporosis defect healing and the assessment of stably and efficiently induced osteogenesis. The experimenters were blinded to group assignment until the completion of the procedure, and again at the time of the results assessment analysis performed with various techniques.

B.3. Histopathological Analysis

For all the experimental conditions, the femoral defect sites were removed and resin embedded without prior demineralization, after which successive coronal sections were produced. A thorough histopathological analysis has been then performed on these sections in order to assess tissue and cellular structure and therefore the osteogenesis, osteoinduction, osteoconduction and bone resorption processes with the following stainings:

Hematoxylin-Eosin (HE) staining to qualitatively analyze tissue morphology as well as: presence or not of the administrated compounds, bone remodeling (bone formation and bone resorption) at the defect sites, the presence of osteoblast cells. A semi-quantitative analysis of osteoblast cell detection was performed, as the presence of osteoblasts in the defect site area is an indicator of osteoinduction and new bone formation.

Tartrate-resistant acid phosphatase (TRAP) staining: to highlight active osteoclasts (in red) that produce the TRAP-isoenzyme but also the osteoclast fraction at the defect sites and its surroundings. Osteoclast activity is an indicator of bone resorption.

Von Kossa Van Gieson (VKVG) staining: to highlight mineralized tissue (in black) including newly formed bone tissue, native bone, and the calcified compounds as well as the non mineralized osteoid tissue (dark pink). The fibrous tissue is stained in light pink and the bone marrow in light orange. The VKVG staining allows assessing the percentage of mineralized and osteoid tissue in and around the defect site as well as the amount of remaining compounds at the defect site area 3 and 12 weeks after administration.

In addition, the tolerance rate of the various administered compounds can be evaluated by examining tissue integrity at the defect site, presence and amount of necrotic tissue and presence of inflammatory cell infiltration such as immune cells and macrophages.

C. Results

Figure 22:
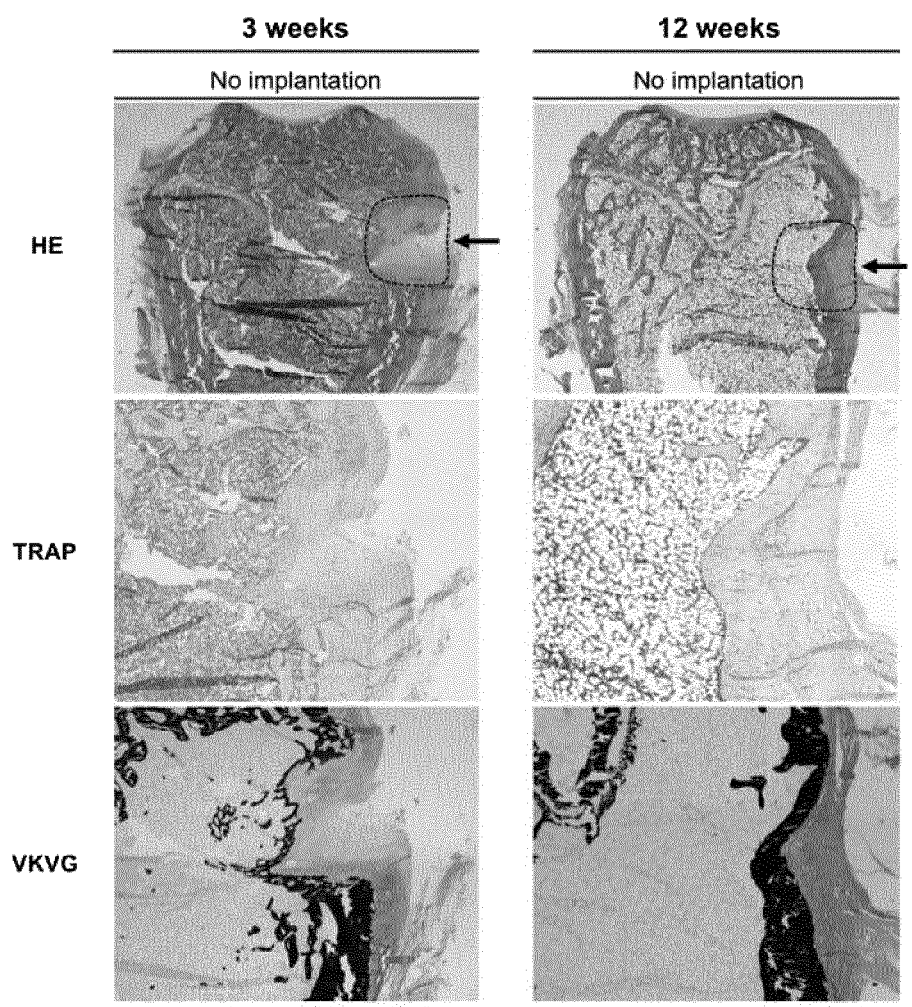
FIG. 22 is a Histological analysis of coronal sections of the femoral defect site for the "No implantation" condition, 3 weeks (left) and 12 weeks (right) after inducing a critical size defect. 3 types of stainings were performed on the sections: Haematoxylin and Eosin staining (HE) to qualitatively analyze tissue morphology; Tartrate-Resistant Acid Phosphatase (TRAP) staining to highlight the active osteoclasts (red) fraction inside bone tissue (light blue); Von Kossa and Van Gieson (VKVG) staining to highlight mineralized bone tissue (black), non mineralized osteoid tissue (dark pink) and fibrous tissue (light pink). The discontinuous lines on the HE staining indicate the approximate defect site area and the black arrows indicate the defect site entry.

Regarding the "No implantation" condition, 3 weeks after inducing a critical size defect, a thickening of the periosteum (fibrous tissue) can be observed at the defect entry for all the stainings (FIG. 22, left). This indicates that a closing of the defect site entry has been initiated and completed after 12 weeks (FIG. 22, right). In addition, no inflammatory cells could be detected in the periosteum suggesting a complete lack of surgery related inflammatory process at 3 weeks. Osteoclast activity is present at the defect entry at 3 weeks but no active osteoclasts could be detected after 12 weeks (FIG. 22, TRAP staining). Finally, mineralized bone tissue is observed at the defect site entry at 3 weeks with very little osteoid tissue (FIG. 22, VKVG staining) and the defect entry is closed after 12 weeks with mineralized tissue. However, no osteoid tissue could be detected in contact with the mineralized tissue at the defect entry at 12 weeks suggesting the absence of any bone formation activity. In addition, no bone tissue structures or bone trabeculae could be detected inside the defect, indicating that osteogenic activity did not occur in that area during 12 weeks. Thus, 12 weeks after inducing a critical size defect in the "No implantation" condition, the entry of the defect site was closed with mineralized bone tissue and periosteum thickening. No osteoid tissue could be detected at the entry site and no bone tissue structures or osteoid could be observed inside the defect area indicating a complete lack of bone formation and osteogenic activity.

Three weeks after HTD-PCL-M01 administration at the defect site, a periosteum closing of the defect entry has been initiated and completed at 12 weeks as observed on all the stainings (FIG. 23A, right and FIG. 23B, right). The periosteum infiltration at the defect entry is associated with an increased resorption of the granulated ceramics of the HTD-PCL-M01 condition as compared to Control 2 for all of the stainings (FIGS. 23A and B). Strikingly, the defect site edges are clearly visible in the HTD-PCL-M01 condition as compared to Control 2 where the edges cannot be distinguished (FIG. 23A, VKVG staining). This is due to the important osteoid formation induced 3 weeks after HTD-PCL-M01 site administration. This important osteogenic activity induced by the HTD-PCL-M01 compound is further confirmed by the observed increase in bone trabeculae and defect filling at 3 weeks and a further increase in bone trabeculae combined with a cortical bone thickening at 12 weeks (FIGS. 23A and B, HE staining). This osteogenic activity is associated with the presence of osteoblast cells around the HTD-PCL-M01 compound, which is not the case for the Control 2 condition (FIGS. 23A and B, HE staining). Moreover, less active osteoclast cells could be detected in the HTD-PCL-M01 condition as compared to Control 2, suggesting a decreased osteoclast activity 3 and 12 weeks after HTD-PCL-M01 administration (FIGS. 23A and B, TRAP staining). Strikingly, an important increase in mineralized and osteoid tissue is observed inside the defect and at the defect entry 12 weeks after HTD-PCL-M01 compound administration as compared to Control 2 (FIG. 23B, VKVG staining). This indicates a further increase in osteogenic activity between 3 and 12 weeks for the HTD-PCL-M01 condition.

In conclusion, HTD-PCL-M01 is very efficiently inducing bone formation at a critical defect site as revealed by an increased osteoid and mineralized bone tissue formation 3 and 12 weeks after administration. This increased osteogenic activity is associated with the presence of osteoblast cells, a decreased osteoclast (bone resorption) activity and an increase in ceramics resorption. This indicates that HTD-PCL-M01 triggers osteoinduction in addition to osteoconduction. The HTD-PCL-M01 compound is therefore very well suited for efficient bone reconstruction of osteoporosis related fractures as compared to the granulated ceramic powder of Control 2, which is a product already present on the market for bone reconstruction.

D. Conclusions

The present CRO-conducted blind randomized preclinical pilot trial has validated the efficiency of a covalently bound representative GFR-binding compound as disclosed herein, for the treatment and prevention of osteoporosis and osteoporosis related fractures in an osteoporosis animal model. Osteoinductive activity was observed through bone tissue regeneration of critical size induced defects. The representative GFR-binding compounds were well tolerated and have efficiently induced bone formation as revealed by an increased osteoid and mineralized bone tissue formation at the defect area, 3 and 12 weeks after administration.

It was shown that HTD-PCL-M01 increased bone formation activity, increased the amount of osteoblast cells, decreased osteoclast (bone resorption) activity and increased ceramics resorption. This indicates that HTD-PCL-M01 triggers osteoinduction in addition to osteoconduction. HTD-PCL-M01 is therefore very well suited for efficient site administration as combined medical device for bone reconstruction of osteoporosis related fractures.

At 3 weeks, the compound has induced the early osteogenesis process involving stem cells and progenitor cells differentiation towards the osteoblast lineage. At 12 weeks the compound was proven efficient in inducing stable osteogenesis and inducing efficient osteoporosis defect healing. These results obtained after 12 weeks are of utmost importance for patients having osteoporotic related fractures, who usually remain significantly impaired for much longer periods of time or permanently.

Thus, GFR-binding compounds of the present disclosure represent new therapeutic solutions for osteoporosis with the unique ability to decouple bone resorption from bone formation by increasing bone formation and concomitantly decreasing bone resorption, which is required to achieve efficient bone strengthening in osteoporosis patients as compared to the existing treatments.

Advantageously, the animals used in the experiments did not present any deleterious side effects regardless of the experimental condition. In addition, the animal body weight was monitored twice a week during the course of the experiment, and a very slight weight loss was observed just after the ovariectomy surgery due to the anesthesia related decrease in food intake for all the animals, which is classically observed for this animal model. No compound administration related weight loss could be detected. Combined with the complete absence of deleterious side effects, this indicates that the administered compound did not negatively interfere with the normal animal metabolism and physiology. Moreover, no animals were euthanized during the course of the experiment due to advanced state of morbidity or signs of pain. The animals were euthanized at the experimental endpoints 3 or 12 weeks after compound administration and a macroscopic post-mortem analysis was performed on the entire animal and specifically at the administration sites. The analysis has revealed no visible signs of inflammation or necrosis at the administration sites for all the animals. This indicates that the compound was well tolerated by the animals, which was also confirmed microscopically by the very small amount of immune cells at the administration sites. Finally, no animals with indications of the osteopetrosis disorder were detected.

SEQUENCE LISTING (6622 sequences)

SEQ ID NO: 1 - protein, 21 aa, Artificial Sequence
  GFR-binding peptide
  MOD_RES (7)..(8): Xaa is C or S
CGSAGPXXVPTKMSAISMLYL

SEQ ID NO: 2 - protein, 21 aa, Artificial Sequence
  GFR-binding peptide
  MOD_RES (7)..(8): Xaa is C or S
CAAPASXXVPTRLSAISMLYL

SEQ ID NO: 3 - protein, 21 aa, Artificial Sequence
  GFR-binding peptide
  MOD_RES (7)..(8): Xaa is C or S
CSTPPTXXVPTRLSAISMLYL

SEQ ID NO: 4 - protein, 21 aa, Artificial Sequence
  GFR-binding peptide
  MOD_RES (8)..(8): Xaa is C or S
CNDEGLEXAPTEENAISVLYF

SEQ ID NO: 5 - protein, 21 aa, Artificial Sequence
  GFR-binding peptide
  MOD_RES (8)..(8): Xaa is C or S
CNDEGLEXAPTGQNAISVLYF

SEQ ID NO: 6 - protein, 21 aa, Artificial Sequence
  GFR-binding peptide
  MOD_RES (7)..(8): Xaa is C or S
CKIPKAXXVPTELSATSVLYY

SEQ ID NO: 7 - protein, 21 aa, Artificial Sequence
  GFR-binding peptide
  MOD_RES (7)..(8): Xaa is C or S
CGIPEPXXVPEKMSATSVLYY

SEQ ID NO: 8 - protein, 21 aa, Artificial Sequence
  GFR-binding peptide
  MOD_RES (7)..(8): Xaa is C or S
CGSAGPXXVPTKMSPISVLYK

SEQ ID NO: 9 - protein, 21 aa, Artificial Sequence
  GFR-binding peptide
  MOD_RES (8)..(8): Xaa is C or S
CHVTKPTXVPEKLSSLSILFF

SEQ ID NO: 10 - protein, 21 aa, Artificial Sequence
  GFR-binding peptide
  MOD_RES (7)..(8): Xaa is C or S
CKVGKAXXVSQKLEPLTILYY

SEQ ID NO: 11 - protein, 21 aa, Artificial Sequence
  GFR-binding peptide
  MOD_RES (6)..(6): Xaa is C or S
CRNVQXRPTQVQLNAISVLYF

SEQ ID NO: 12 - protein, 21 aa, Artificial Sequence
  GFR-binding peptide
  MOD_RES (7)..(8): Xaa is C or S
CHVPKPXXAPTKLSAISMLYL

SEQ ID NO: 13 - protein, 21 aa, Artificial Sequence
  GFR-binding peptide
  MOD_RES (7)..(8): Xaa is C or S
CKVGKAXXVPTKLEPLTILYY

SEQ ID NO: 14 - protein, 21 aa, Artificial Sequence
  GFR-binding peptide
  MOD_RES (6)..(6): Xaa is C or S
CRNVQXRPTQVQLSAISMLYL

SEQ ID NO: 15 - protein, 21 aa, Artificial Sequence
  GFR-binding peptide
  MOD_RES (7)..(8): Xaa is C or S
CASASPXXVSQDLSAISMLYL

SEQ ID NO: 16 - protein, 21 aa, Artificial Sequence
  GFR-binding peptide
  MOD_RES (7)..(8): Xaa is C or S
CHVPKPXXVPTKLSPISVLYK

SEQ ID NO: 17 - protein, 21 aa, Artificial Sequence
  GFR-binding peptide
  MOD_RES (8)..(8): Xaa is C or S
CNDEGLEXVPTGQNAISVLYF

SEQ ID NO: 18 - protein, 21 aa, Artificial Sequence
  GFR-binding peptide
  MOD_RES (7)..(8): Xaa is C or S
CTVPKPXXAPTQLSAISMLYL

SEQ ID NO: 19 - protein, 21 aa, Artificial Sequence
  GFR-binding peptide
  MOD_RES (7)..(8): Xaa is C or S
CAVPKAXXAPTKLSAISMLYL

SEQ ID NO: 20 - protein, 21 aa, Artificial Sequence
  GFR-binding peptide
  MOD_RES (7)..(8): Xaa is C or S
CKVGKAXXVPTKLSAISMLYL

SEQ ID NO: 21 - protein, 21 aa, Artificial Sequence
  GFR-binding peptide
  MOD_RES (7)..(8): Xaa is C or S
CGGGKAXXVPTKLSAISMLYL

SEQ ID NO: 22 - protein, 24 aa, Artificial Sequence
  GFR-binding peptide
  MOD_RES (10)..(11): Xaa is C or S
WWFWGSAGPXXTPTKMSAISMLYL

SEQ ID NO: 23 - protein, 25 aa, Artificial Sequence
  GFR-binding peptide
  MOD_RES (12)..(12): Xaa is C or S
GTPGPHVTKPTXVPTKLSAISMLYL

SEQ ID NO: 24 - protein, 18 aa, Artificial Sequence
  GFR-binding peptide
GTPGPVPQELEPLTILYY

SEQ ID NO: 25 - protein, 18 aa, Artificial Sequence
  GFR-binding peptide
GTPGPVPTELSPISVLYK

SEQ ID NO: 26 - protein, 21 aa, Artificial Sequence
  GFR-binding peptide
  MOD_RES (7)..(8): Xaa is C or S
GTPGPAXXVPTKLSAISMLYL

SEQ ID NO: 27 - protein, 18 aa, Artificial Sequence
  GFR-binding peptide
GTPGPVPTGQSAISMLYL

SEQ ID NO: 28 - protein, 18 aa, Artificial Sequence
  GFR-binding peptide
GTPGPVPTEESAISMLYL

SEQ ID NO: 29 - protein, 21 aa, Artificial Sequence
  GFR-binding peptide
GTPGPPTSVPTKLSPISVLYK

SEQ ID NO: 30 - protein, 21 aa, Artificial Sequence
  GFR-binding peptide
  MOD_RES (7)..(8): Xaa is C or S
GTPGPPXXVPTKLSPISVLYK

SEQ ID NO: 31 - protein, 25 aa, Artificial Sequence
  GFR-binding peptide
  MOD_RES (12)..(12): Xaa is C or S
GTPGPNDEGLEXAPTGQNAISVLYF

SEQ ID NO: 32 - protein, 25 aa, Artificial Sequence
  GFR-binding peptide
  MOD_RES (11)..(12): Xaa is C or S
WWFWGAAPASXXVPTRLSPISVLYK

SEQ ID NO: 33 - protein, 25 aa, Artificial Sequence
  GFR-binding peptide
  MOD_RES (11)..(12): Xaa is C or S
WWFWGKASKAXXVPTKLSAISMLYL

SEQ ID NO: 34 - protein, 25 aa, Artificial Sequence
  GFR-binding peptide
  MOD_RES (11)..(12): Xaa is C or S
GTPGPGSAGPXXTPTKMSAISMLYL

SEQ ID NO: 35 - protein, 25 aa, Artificial Sequence
  GFR-binding peptide
  MOD_RES (11)..(12): Xaa is C or S
GTPGPAAPASXXVPARLSAISMLYL

SEQ ID NO: 36 - protein, 21 aa, Artificial Sequence
  GFR-binding peptide
  MOD_RES (7)..(8): Xaa is C or S
CAVPKAXXAPTKLEPLPIVYY

SEQ ID NO: 37 - protein, 21 aa, Artificial Sequence
  GFR-binding peptide
  MOD_RES (7)..(8): Xaa is C or S
CKIPKAXXVSQELEPLTILYY

SEQ ID NO: 38 - protein, 21 aa, Artificial Sequence
  GFR-binding peptide
  MOD_RES (7)..(8): Xaa is C or S
CSTPPTXXSRVRLRSVKVAKV

SEQ ID NO: 39 - protein, 21 aa, Artificial Sequence
  GFR-binding peptide
  MOD_RES (7)..(8): Xaa is C or S
CKVGKAXXVPTKLSNITMQIM

SEQ ID NO: 40 - protein, 21 aa, Artificial Sequence
  GFR-binding peptide
  MOD_RES (7)..(8): Xaa is C or S
CASASPXXTQVDLRPVQVRKI

SEQ ID NO: 41 - protein, 21 aa, Artificial Sequence
  GFR-binding peptide
  MOD_RES (7)..(8): Xaa is C or S
CAASKAXXVPEKLSSLSILFF

SEQ ID NO: 42 - protein, 21 aa, Artificial Sequence
  GFR-binding peptide
  MOD_RES (7)..(8): Xaa is C or S
CGSAGPXXVPEKMSSLSILFF

SEQ ID NO: 43 - protein, 21 aa, Artificial Sequence
  GFR-binding peptide
  MOD_RES (7)..(8): Xaa is C or S
CRVPSTXXVPAKTSPISILYI

SEQ ID NO: 44 - protein, 21 aa, Artificial Sequence
  GFR-binding peptide
  MOD_RES (7)..(8): Xaa is C or S
CASAAPXXVPAALSPISILYI

SEQ ID NO: 45 - protein, 21 aa, Artificial Sequence
  GFR-binding peptide
  MOD_RES (8)..(8): Xaa is C or S
CNDEGLEXVPAEESPISILYI

SEQ ID NO: 46 - protein, 14 aa, Artificial Sequence
  GFR-binding peptide
CVPAGQSPISILYI

SEQ ID NO: 47 - protein, 21 aa, Artificial Sequence
  GFR-binding peptide
  MOD_RES (8)..(8): Xaa is C or S
CNDEGLEXVPAEESPISILYI

SEQ ID NO: 48 - protein, 14 aa, Artificial Sequence
  GFR-binding peptide
CVPAEESPISILYI

SEQ ID NO: 49 - protein, 21 aa, Artificial Sequence
  GFR-binding peptide
  MOD_RES (7)..(8): Xaa is C or S
CGIPEPXXVPAKMSPISILYI

SEQ ID NO: 50 - protein, 21 aa, Artificial Sequence
  GFR-binding peptide
  MOD_RES (7)..(8): Xaa is C or S
CASAAPXXVPQALRPVQVRKI

SEQ ID NO: 51 - protein, 19 aa, Artificial Sequence
  GFR-binding peptide
  MOD_RES (5)..(6): Xaa is C or S
CASPXXVSQDLRPVQVRKI

SEQ ID NO: 52 - protein, 21 aa, Artificial Sequence
  GFR-binding peptide
  MOD_RES (7)..(8): Xaa is C or S
CASASPXXVPQDLRPVQVRKI

SEQ ID NO: 53 - protein, 21 aa, Artificial Sequence
  GFR-binding peptide
  MOD_RES (8)..(8): Xaa is C or S
CNDEGLEXVPTEERPVQVRKI

SEQ ID NO: 54 - protein, 9 aa, Artificial Sequence
  GFR-binding peptide
CRPVQVRKI

SEQ ID NO: 55 - protein, 21 aa, Artificial Sequence
  GFR-binding peptide
  MOD_RES (7)..(8): Xaa is C or S
CTVPKPXXVPTQLSNITMQIM

SEQ ID NO: 56 - protein, 21 aa, Artificial Sequence
  GFR-binding peptide
  MOD_RES (7)..(8): Xaa is C or S
CAVPKAXXVPTKLSNITMQIM

SEQ ID NO: 57 - protein, 21 aa, Artificial Sequence
  GFR-binding peptide
  MOD_RES (7)..(8): Xaa is C or S
CSIPKAXXTPTELSPINMLYF

SEQ ID NO: 58 - protein, 19 aa, Artificial Sequence
  GFR-binding peptide
CTKPTSTPTKLSPINMLYF

SEQ ID NO: 59 - protein, 21 aa, Artificial Sequence
  GFR-binding peptide
  MOD_RES (7)..(8): Xaa is C or S
CYVPKPXXTPTKLSPINMLYF

SEQ ID NO: 60 - protein, 21 aa, Artificial Sequence
  GFR-binding peptide
  MOD_RES (7)..(8): Xaa is C or S
CASAAPXXVPQALSSLSILFF

SEQ ID NO: 61 - protein, 21 aa, Artificial Sequence
  GFR-binding peptide
  MOD_RES (7)..(8): Xaa is C or S
CASASPXXVSQDLSSLSILFF

SEQ ID NO: 62 - protein, 21 aa, Artificial Sequence
  GFR-binding peptide
  MOD_RES (7)..(8): Xaa is C or S
CVVPKPXXAPTQLEPISILYL

SEQ ID NO: 63 - protein, 21 aa, Artificial Sequence
  GFR-binding peptide
  MOD_RES (7)..(8): Xaa is C or S
CAVPKAXXAPTKLEPISILYL

SEQ ID NO: 64 - protein, 21 aa, Artificial Sequence
  GFR-binding peptide
  MOD_RES (7)..(8): Xaa is C or S
CKVGKAXXVPTKLEPISILYL

SEQ ID NO: 65 - protein, 21 aa, Artificial Sequence
  GFR-binding peptide
  MOD_RES (6)..(6): Xaa is C or S
CSSVKXQPSRVHHKPLSMLYV

SEQ ID NO: 66 - protein, 21 aa, Artificial Sequence
  GFR-binding peptide
  MOD_RES (6)..(6): Xaa is C or S
CRNVQXRPTQVQLKPLSMLYV

SEQ ID NO: 67 - protein, 21 aa, Artificial Sequence
  GFR-binding peptide
  MOD_RES (7)..(8): Xaa is C or S
CKIPKAXXVPQELEPLPIVYY

SEQ ID NO: 68 - protein, 21 aa, Artificial Sequence
  GFR-binding peptide
  MOD_RES (7)..(8): Xaa is C or S
CGIPEPXXVPQKMEPLPIVYY

SEQ ID NO: 69 - protein, 21 aa, Artificial Sequence
  GFR-binding peptide
  MOD_RES (7)..(8): Xaa is C or S
CSIPKAXXVPQELEPLPIVYY

SEQ ID NO: 70 - protein, 21 aa, Artificial Sequence
  GFR-binding peptide
  MOD_RES (7)..(8): Xaa is C or S
CASAAPXXVPQALEPLTILYY

SEQ ID NO: 71 - protein, 21 aa, Artificial Sequence
  GFR-binding peptide
  MOD_RES (7)..(8): Xaa is C or S
CASASPXXVSQDLEPLTILYY

SEQ ID NO: 72 - protein, 21 aa, Artificial Sequence
  GFR-binding peptide
  MOD_RES (8)..(8): Xaa is C or S
CNDEGLEXVPTEEEPLTILYY

SEQ ID NO: 73 - protein, 21 aa, Artificial Sequence
  GFR-binding peptide
  MOD_RES (8)..(8): Xaa is C or S
CNDEGLEXVPTEESSLSILFF

SEQ ID NO: 74 - protein, 21 aa, Artificial Sequence
  GFR-binding peptide
  MOD_RES (7)..(8): Xaa is C or S
CKASKAXXVPTKLSNITMQIM

SEQ ID NO: 75 - protein, 21 aa, Artificial Sequence
  GFR-binding peptide
  MOD_RES (7)..(8): Xaa is C or S
CGSAGPXXTPTKMSNITMQIM

SEQ ID NO: 76 - protein, 21 aa, Artificial Sequence
  GFR-binding peptide
  MOD_RES (7)..(8): Xaa is C or S
CAAPASXXVPARLSNITMQIM

SEQ ID NO: 77 - protein, 21 aa, Artificial Sequence
  GFR-binding peptide
  MOD_RES (7)..(8): Xaa is C or S
CRVPSTXXAPTKTSATSVLYY

SEQ ID NO: 78 - protein, 21 aa, Artificial Sequence
  GFR-binding peptide
  MOD_RES (7)..(8): Xaa is C or S
CASAAPXXAPTALSATSVLYY

SEQ ID NO: 79 - protein, 21 aa, Artificial Sequence
  GFR-binding peptide
  MOD_RES (7)..(8): Xaa is C or S
CASASPXXAPTDLSATSVLYY

SEQ ID NO: 80 - protein, 21 aa, Artificial Sequence
  GFR-binding peptide
  MOD_RES (7)..(8): Xaa is C or S
CSIPKAXXVPTELRSVKVAKV

SEQ ID NO: 81 - protein, 21 aa, Artificial Sequence
  GFR-binding peptide
  MOD_RES (8)..(8): Xaa is C or S
CHVTKPTXAPTKLRSVKVAKV

SEQ ID NO: 82 - protein, 21 aa, Artificial Sequence
  GFR-binding peptide
  MOD_RES (7)..(8): Xaa is C or S
CTVPKPXXAPTQLRSVKVAKV

SEQ ID NO: 83 - protein, 21 aa, Artificial Sequence
  GFR-binding peptide
  MOD_RES (7)..(8): Xaa is C or S
CKVGKAXXVPQKLEPLPIVYY

SEQ ID NO: 84 - protein, 21 aa, Artificial Sequence
  GFR-binding peptide
  MOD_RES (7)..(8): Xaa is C or S
CKASKAXXVPQKLEPLPIVYY

SEQ ID NO: 85 - protein, 21 aa, Artificial Sequence
  GFR-binding peptide
  MOD_RES (6)..(6): Xaa is C or S
CRNVQXRPVPTQLSPISVLYK

SEQ ID NO: 86 - protein, 21 aa, Artificial Sequence
  GFR-binding peptide
  MOD_RES (7)..(8): Xaa is C or S
CKIPKAXXVPTELSPISVLYK

SEQ ID NO: 87 - protein, 21 aa, Artificial Sequence
  GFR-binding peptide
  MOD_RES (7)..(8): Xaa is C or S
CASAAPXXVPQALRSVKVAKV

SEQ ID NO: 88 - protein, 14 aa, Artificial Sequence
  GFR-binding peptide
CVSQDLRSVKVAKV

SEQ ID NO: 89 - protein, 21 aa, Artificial Sequence
  GFR-binding peptide
  MOD_RES (7)..(8): Xaa is C or S
CASASPXXVPQDLRSVKVAKV

SEQ ID NO: 90 - protein, 21 aa, Artificial Sequence
  GFR-binding peptide
  MOD_RES (8)..(8): Xaa is C or S
CNDEGLEXVPTEERSVKVAKV

SEQ ID NO: 91 - protein, 14 aa, Artificial Sequence
  GFR-binding peptide
CTQVKMRPVQVRKI

SEQ ID NO: 92 - protein, 21 aa, Artificial Sequence
  GFR-binding peptide
  MOD_RES (7)..(8): Xaa is C or S
CSIPKAXXTQVELRPVQVRKI

SEQ ID NO: 93 - protein, 21 aa, Artificial Sequence
  GFR-binding peptide
  MOD_RES (7)..(8): Xaa is C or S
CKIPKAXXTPTELSPINMLYF

SEQ ID NO: 94 - protein, 21 aa, Artificial Sequence
  GFR-binding peptide
  MOD_RES (7)..(8): Xaa is C or S
CGIPEPXXTPTKMSPINMLYF

SEQ ID NO: 95 - protein, 14 aa, Artificial Sequence
  GFR-binding peptide
CVPTGQSAISMLYL

SEQ ID NO: 96 - protein, 21 aa, Artificial Sequence
  GFR-binding peptide
  MOD_RES (8)..(8): Xaa is C or S
CNDEGLEXVPTEESAISMLYL

SEQ ID NO: 97 - protein, 21 aa, Artificial Sequence
  GFR-binding peptide
  MOD_RES (8)..(8): Xaa is C or S
CNDEGLEXVPTEESPISILYI

SEQ ID NO: 98 - protein, 21 aa, Artificial Sequence
  GFR-binding peptide
  MOD_RES (6)..(6): Xaa is C or S
CVVVKXQPSRVHHSPISILYI

SEQ ID NO: 99 - protein, 21 aa, Artificial Sequence
  GFR-binding peptide
  MOD_RES (6)..(6): Xaa is C or S
CSSVKXQPSRVHHSPISILFI

SEQ ID NO: 100 - protein, 21 aa, Artificial Sequence
  GFR-binding peptide
  MOD_RES (6)..(6): Xaa is C or S
CRNVQXRPTQVQLSPISILFI

SEQ ID NO: 101 - protein, 21 aa, Artificial Sequence
  GFR-binding peptide
  MOD_RES (7)..(8): Xaa is C or S
CYVPKPXXAPTKLNAISVLYF

SEQ ID NO: 102 - protein, 21 aa, Artificial Sequence
  GFR-binding peptide
  MOD_RES (7)..(8): Xaa is C or S
CRVPSTXXVPTKTSAISMLYL

SEQ ID NO: 103 - protein, 21 aa, Artificial Sequence
  GFR-binding peptide
  MOD_RES (7)..(8): Xaa is C or S
CHVPKPXXAPTKLEPISILYL

SEQ ID NO: 104 - protein, 21 aa, Artificial Sequence
  GFR-binding peptide
  MOD_RES (7)..(8): Xaa is C or S
CRVPSTXXAPVKTEPISILYL

SEQ ID NO: 105 - protein, 20 aa, Artificial Sequence
  GFR-binding peptide
  MOD_RES (6)..(7): Xaa is C or S
GIPEPXXVPTKMSAISMLYL

SEQ ID NO: 106 - protein, 20 aa, Artificial Sequence
  GFR-binding peptide
  MOD_RES (7)..(7): Xaa is C or S
HVTKPTXVPTKLSAISMLYL

SEQ ID NO: 107 - protein, 20 aa, Artificial Sequence
  GFR-binding peptide
  MOD_RES (6)..(7): Xaa is C or S
YVPKPXXVPTKLSAISMLYL

SEQ ID NO: 108 - protein, 20 aa, Artificial Sequence
  GFR-binding peptide
  MOD_RES (6)..(7): Xaa is C or S
TVPKPXXVPTQLSAISMLYL

SEQ ID NO: 109 - protein, 20 aa, Artificial Sequence
  GFR-binding peptide
  MOD_RES (6)..(7): Xaa is C or S
AVPKAXXVPTKLSAISMLYL

SEQ ID NO: 110 - protein, 20 aa, Artificial Sequence
  GFR-binding peptide
  MOD_RES (6)..(7): Xaa is C or S
KASKAXXVPTKLSAISMLYL

SEQ ID NO: 111 - protein, 20 aa, Artificial Sequence
  GFR-binding peptide
  MOD_RES (6)..(7): Xaa is C or S
HVPKPXXVPTKLSAISMLYL

SEQ ID NO: 112 - protein, 20 aa, Artificial Sequence
  GFR-binding peptide
  MOD_RES (6)..(7): Xaa is C or S
ASAAPXXVPTALSAISMLYL

SEQ ID NO: 113 - protein, 20 aa, Artificial Sequence
  GFR-binding peptide
  MOD_RES (6)..(7): Xaa is C or S
ASASPXXVPTDLSAISMLYL

SEQ ID NO: 114 - protein, 20 aa, Artificial Sequence
  GFR-binding peptide
  MOD_RES (6)..(7): Xaa is C or S
ASASPXXVPTDLSAISMLYL

SEQ ID NO: 115 - protein, 20 aa, Artificial Sequence
  GFR-binding peptide
  MOD_RES (6)..(7): Xaa is C or S
GIPEPXXVPEKMSAISMLYL

SEQ ID NO: 116 - protein, 20 aa, Artificial Sequence
  GFR-binding peptide
  MOD_RES (7)..(7): Xaa is C or S
HVTKPTXAPTKLSAISMLYL

SEQ ID NO: 117 - protein, 20 aa, Artificial Sequence
  GFR-binding peptide
  MOD_RES (6)..(7): Xaa is C or S
YVPKPXXAPTKLSAISMLYL

SEQ ID NO: 118 - protein, 20 aa, Artificial Sequence
  GFR-binding peptide
  MOD_RES (6)..(7): Xaa is C or S
GSAGPXXTPTKMSAISMLYL

SEQ ID NO: 119 - protein, 20 aa, Artificial Sequence
  GFR-binding peptide
  MOD_RES (6)..(7): Xaa is C or S
AAPASXXVPARLSAISMLYL

SEQ ID NO: 120 - protein, 20 aa, Artificial Sequence
  GFR-binding peptide
  MOD_RES (6)..(7): Xaa is C or S
RVPSTXXAPVKTSAISMLYL

SEQ ID NO: 121 - protein, 20 aa, Artificial Sequence
  GFR-binding peptide
  MOD_RES (6)..(7): Xaa is C or S
ASAAPXXVPQALSAISMLYL

SEQ ID NO: 122 - protein, 20 aa, Artificial Sequence
  GFR-binding peptide
  MOD_RES (6)..(7): Xaa is C or S
ASASPXXVPQDLSAISMLYL

SEQ ID NO: 123 - protein, 20 aa, Artificial Sequence
  GFR-binding peptide
  MOD_RES (5)..(5): Xaa is C or S
SSVKXQPSRVHHSAISMLYL

SEQ ID NO: 124 - protein, 20 aa, Artificial Sequence
  GFR-binding peptide
  MOD_RES (6)..(7): Xaa is C or S
KIPKAXXVPEELSSLSILFF

SEQ ID NO: 125 - protein, 20 aa, Artificial Sequence
  GFR-binding peptide
  MOD_RES (6)..(7): Xaa is C or S
SIPKAXXVPEELSSLSILFF

SEQ ID NO: 126 - protein, 20 aa, Artificial Sequence
  GFR-binding peptide
  MOD_RES (6)..(7): Xaa is C or S
YVPKPXXVPEKLSSLSILFF

SEQ ID NO: 127 - protein, 20 aa, Artificial Sequence
  GFR-binding peptide
  MOD_RES (6)..(7): Xaa is C or S
TVPKPXXVPEQLSSLSILFF

SEQ ID NO: 128 - protein, 20 aa, Artificial Sequence
  GFR-binding peptide
  MOD_RES (6)..(7): Xaa is C or S
AVPKAXXVPEKLSSLSILFF

SEQ ID NO: 129 - protein, 20 aa, Artificial Sequence
  GFR-binding peptide
  MOD_RES (6)..(7): Xaa is C or S
KVGKAXXVPEKLSSLSILFF

SEQ ID NO: 130 - protein, 20 aa, Artificial Sequence
  GFR-binding peptide
  MOD_RES (6)..(7): Xaa is C or S
KASKAXXVPEKLSSLSILFF

SEQ ID NO: 131 - protein, 20 aa, Artificial Sequence
  GFR-binding peptide
  MOD_RES (6)..(7): Xaa is C or S
AAPASXXVPERLSSLSILFF

SEQ ID NO: 132 - protein, 20 aa, Artificial Sequence
  GFR-binding peptide
  MOD_RES (6)..(7): Xaa is C or S
STPPTXXVPERLSSLSILFF

SEQ ID NO: 133 - protein, 20 aa, Artificial Sequence
  GFR-binding peptide
  MOD_RES (6)..(7): Xaa is C or S
HVPKPXXVPEKLSSLSILFF

SEQ ID NO: 134 - protein, 20 aa, Artificial Sequence
  GFR-binding peptide
  MOD_RES (6)..(7): Xaa is C or S
RVPSTXXVPEKTSSLSILFF

SEQ ID NO: 135 - protein, 20 aa, Artificial Sequence
  GFR-binding peptide
  MOD_RES (6)..(7): Xaa is C or S
ASAAPXXVPEALSSLSILFF

SEQ ID NO: 136 - protein, 20 aa, Artificial Sequence
  GFR-binding peptide
  MOD_RES (6)..(7): Xaa is C or S
ASASPXXVPEDLSSLSILFF

SEQ ID NO: 137 - protein, 20 aa, Artificial Sequence
  GFR-binding peptide
  MOD_RES (6)..(7): Xaa is C or S
ASASPXXVPEDLSSLSILFF

SEQ ID NO: 138 - protein, 20 aa, Artificial Sequence
  GFR-binding peptide
  MOD_RES (6)..(7): Xaa is C or S
KIPKAXXVPTELSSLSILFF

SEQ ID NO: 139 - protein, 20 aa, Artificial Sequence
  GFR-binding peptide
  MOD_RES (6)..(7): Xaa is C or S
SIPKAXXVPTELSSLSILFF

SEQ ID NO: 140 - protein, 20 aa, Artificial Sequence
  GFR-binding peptide
  MOD_RES (7)..(7): Xaa is C or S
HVTKPTXAPTKLSSLSILFF

SEQ ID NO: 141 - protein, 20 aa, Artificial Sequence
  GFR-binding peptide
  MOD_RES (6)..(7): Xaa is C or S
YVPKPXXAPTKLSSLSILFF

SEQ ID NO: 142 - protein, 20 aa, Artificial Sequence
  GFR-binding peptide
  MOD_RES (6)..(7): Xaa is C or S
TVPKPXXAPTQLSSLSILFF

SEQ ID NO: 143 - protein, 20 aa, Artificial Sequence
  GFR-binding peptide
  MOD_RES (6)..(7): Xaa is C or S
AVPKAXXAPTKLSSLSILFF

SEQ ID NO: 144 - protein, 20 aa, Artificial Sequence
  GFR-binding peptide
  MOD_RES (6)..(7): Xaa is C or S
KVGKAXXVPTKLSSLSILFF

SEQ ID NO: 145 - protein, 20 aa, Artificial Sequence
  GFR-binding peptide
  MOD_RES (6)..(7): Xaa is C or S
KASKAXXVPTKLSSLSILFF

SEQ ID NO: 146 - protein, 20 aa, Artificial Sequence
  GFR-binding peptide
  MOD_RES (6)..(7): Xaa is C or S
GSAGPXXTPTKMSSLSILFF

SEQ ID NO: 147 - protein, 20 aa, Artificial Sequence
  GFR-binding peptide
  MOD_RES (6)..(7): Xaa is C or S
AAPASXXVPARLSSLSILFF

SEQ ID NO: 148 - protein, 20 aa, Artificial Sequence
  GFR-binding peptide
  MOD_RES (6)..(7): Xaa is C or S
STPPTXXVPTRLSSLSILFF

SEQ ID NO: 149 - protein, 20 aa, Artificial Sequence
  GFR-binding peptide
  MOD_RES (6)..(7): Xaa is C or S
HVPKPXXAPTKLSSLSILFF

SEQ ID NO: 150 - protein, 20 aa, Artificial Sequence
  GFR-binding peptide
  MOD_RES (6)..(7): Xaa is C or S
RVPSTXXAPVKTSSLSILFF

SEQ ID NO: 151 - protein, 20 aa, Artificial Sequence
  GFR-binding peptide
  MOD_RES (6)..(7): Xaa is C or S
ASASPXXVPQDLSSLSILFF

SEQ ID NO: 152 - protein, 20 aa, Artificial Sequence
  GFR-binding peptide
  MOD_RES (7)..(7): Xaa is C or S
NDEGLEXVPTGQSSLSILFF

SEQ ID NO: 153 - protein, 20 aa, Artificial Sequence
  GFR-binding peptide
  MOD_RES (5)..(5): Xaa is C or S
SSVKXQPSRVHHSSLSILFF

SEQ ID NO: 154 - protein, 20 aa, Artificial Sequence
  GFR-binding peptide
  MOD_RES (5)..(5): Xaa is C or S
RNVQXRPTQVQLSSLSILFF

SEQ ID NO: 155 - protein, 20 aa, Artificial Sequence
  GFR-binding peptide
  MOD_RES (6)..(7): Xaa is C or S
KIPKAXXAPTELNAISVLYF

SEQ ID NO: 156 - protein, 20 aa, Artificial Sequence
  GFR-binding peptide
  MOD_RES (6)..(7): Xaa is C or S
GIPEPXXAPTKMNAISVLYF

SEQ ID NO: 157 - protein, 20 aa, Artificial Sequence
  GFR-binding peptide
  MOD_RES (6)..(7): Xaa is C or S
SIPKAXXAPTELNAISVLYF

SEQ ID NO: 158 - protein, 20 aa, Artificial Sequence
  GFR-binding peptide
  MOD_RES (6)..(7): Xaa is C or S
AVPKAXXAPTKLNAISVLYF

SEQ ID NO: 159 - protein, 20 aa, Artificial Sequence
  GFR-binding peptide
  MOD_RES (6)..(7): Xaa is C or S
KVGKAXXAPTKLNAISVLYF

SEQ ID NO: 160 - protein, 20 aa, Artificial Sequence
  GFR-binding peptide
  MOD_RES (6)..(7): Xaa is C or S
KASKAXXAPTKLNAISVLYF

SEQ ID NO: 161 - protein, 20 aa, Artificial Sequence
  GFR-binding peptide
  MOD_RES (6)..(7): Xaa is C or S
GSAGPXXAPTKMNAISVLYF

SEQ ID NO: 162 - protein, 20 aa, Artificial Sequence
  GFR-binding peptide
  MOD_RES (6)..(7): Xaa is C or S
AAPASXXAPTRLNAISVLYF

SEQ ID NO: 163 - protein, 20 aa, Artificial Sequence
  GFR-binding peptide
  MOD_RES (6)..(7): Xaa is C or S
STPPTXXAPTRLNAISVLYF

SEQ ID NO: 164 - protein, 20 aa, Artificial Sequence
  GFR-binding peptide
  MOD_RES (6)..(7): Xaa is C or S
RVPSTXXAPTKTNAISVLYF

SEQ ID NO: 165 - protein, 20 aa, Artificial Sequence
  GFR-binding peptide
  MOD_RES (6)..(7): Xaa is C or S
ASAAPXXAPTALNAISVLYF

SEQ ID NO: 166 - protein, 20 aa, Artificial Sequence
  GFR-binding peptide
  MOD_RES (6)..(7): Xaa is C or S
ASASPXXAPTDLNAISVLYF

SEQ ID NO: 167 - protein, 20 aa, Artificial Sequence
  GFR-binding peptide
  MOD_RES (6)..(7): Xaa is C or S
ASASPXXAPTDLNAISVLYF

SEQ ID NO: 168 - protein, 20 aa, Artificial Sequence
  GFR-binding peptide
  MOD_RES (6)..(7): Xaa is C or S
KIPKAXXVPTELNAISVLYF

SEQ ID NO: 169 - protein, 20 aa, Artificial Sequence
  GFR-binding peptide
  MOD_RES (6)..(7): Xaa is C or S
GIPEPXXVPEKMNAISVLYF

SEQ ID NO: 170 - protein, 20 aa, Artificial Sequence
  GFR-binding peptide
  MOD_RES (6)..(7): Xaa is C or S
SIPKAXXVPTELNAISVLYF

SEQ ID NO: 171 - protein, 20 aa, Artificial Sequence
  GFR-binding peptide
  MOD_RES (6)..(7): Xaa is C or S
KVGKAXXVPTKLNAISVLYF

SEQ ID NO: 172 - protein, 20 aa, Artificial Sequence
  GFR-binding peptide
  MOD_RES (6)..(7): Xaa is C or S
KASKAXXVPTKLNAISVLYF

SEQ ID NO: 173 - protein, 20 aa, Artificial Sequence
  GFR-binding peptide
  MOD_RES (6)..(7): Xaa is C or S
GSAGPXXTPTKMNAISVLYF

SEQ ID NO: 174 - protein, 20 aa, Artificial Sequence
  GFR-binding peptide
  MOD_RES (6)..(7): Xaa is C or S
AAPASXXVPARLNAISVLYF

SEQ ID NO: 175 - protein, 20 aa, Artificial Sequence
  GFR-binding peptide
  MOD_RES (6)..(7): Xaa is C or S
STPPTXXVPTRLNAISVLYF

SEQ ID NO: 176 - protein, 20 aa, Artificial Sequence
  GFR-binding peptide
  MOD_RES (6)..(7): Xaa is C or S
RVPSTXXAPVKTNAISVLYF

SEQ ID NO: 177 - protein, 20 aa, Artificial Sequence
  GFR-binding peptide
  MOD_RES (6)..(7): Xaa is C or S
ASAAPXXVPQALNAISVLYF

SEQ ID NO: 178 - protein, 20 aa, Artificial Sequence
  GFR-binding peptide
  MOD_RES (6)..(7): Xaa is C or S
ASASPXXVSQDLNAISVLYF

SEQ ID NO: 179 - protein, 20 aa, Artificial Sequence
  GFR-binding peptide
  MOD_RES (6)..(7): Xaa is C or S
ASASPXXVPQDLNAISVLYF

SEQ ID NO: 180 - protein, 20 aa, Artificial Sequence
  GFR-binding peptide
  MOD_RES (7)..(7): Xaa is C or S
NDEGLEXVPTEENAISVLYF

SEQ ID NO: 181 - protein, 20 aa, Artificial Sequence
  GFR-binding peptide
  MOD_RES (5)..(5): Xaa is C or S
SSVKXQPSRVHHNAISVLYF

SEQ ID NO: 182 - protein, 20 aa, Artificial Sequence
  GFR-binding peptide
  MOD_RES (6)..(7): Xaa is C or S
KIPKAXXAPTELSATSVLYY

SEQ ID NO: 183 - protein, 20 aa, Artificial Sequence
  GFR-binding peptide
  MOD_RES (6)..(7): Xaa is C or S
GIPEPXXAPTKMSATSVLYY

SEQ ID NO: 184 - protein, 20 aa, Artificial Sequence
  GFR-binding peptide
  MOD_RES (6)..(7): Xaa is C or S
SIPKAXXAPTELSATSVLYY

SEQ ID NO: 185 - protein, 20 aa, Artificial Sequence
  GFR-binding peptide
  MOD_RES (7)..(7): Xaa is C or S
HVTKPTXAPTKLSATSVLYY

SEQ ID NO: 186 - protein, 20 aa, Artificial Sequence
  GFR-binding peptide
  MOD_RES (6)..(7): Xaa is C or S
YVPKPXXAPTKLSATSVLYY

SEQ ID NO: 187 - protein, 20 aa, Artificial Sequence
  GFR-binding peptide
  MOD_RES (6)..(7): Xaa is C or S
TVPKPXXAPTQLSATSVLYY

SEQ ID NO: 188 - protein, 20 aa, Artificial Sequence
  GFR-binding peptide
  MOD_RES (6)..(7): Xaa is C or S
KVGKAXXAPTKLSATSVLYY

SEQ ID NO: 189 - protein, 20 aa, Artificial Sequence
  GFR-binding peptide
  MOD_RES (6)..(7): Xaa is C or S
KASKAXXAPTKLSATSVLYY

SEQ ID NO: 190 - protein, 20 aa, Artificial Sequence
  GFR-binding peptide
  MOD_RES (6)..(7): Xaa is C or S
GSAGPXXAPTKMSATSVLYY

SEQ ID NO: 191 - protein, 20 aa, Artificial Sequence
  GFR-binding peptide
  MOD_RES (6)..(7): Xaa is C or S
AAPASXXAPTRLSATSVLYY

SEQ ID NO: 192 - protein, 20 aa, Artificial Sequence
  GFR-binding peptide
  MOD_RES (6)..(7): Xaa is C or S
STPPTXXAPTRLSATSVLYY

SEQ ID NO: 193 - protein, 20 aa, Artificial Sequence
  GFR-binding peptide
  MOD_RES (6)..(7): Xaa is C or S
HVPKPXXAPTKLSATSVLYY

SEQ ID NO: 194 - protein, 20 aa, Artificial Sequence
  GFR-binding peptide
  MOD_RES (6)..(7): Xaa is C or S
SIPKAXXVPTELSATSVLYY

SEQ ID NO: 195 - protein, 20 aa, Artificial Sequence
  GFR-binding peptide
  MOD_RES (6)..(7): Xaa is C or S
KVGKAXXVPTKLSATSVLYY

SEQ ID NO: 196 - protein, 20 aa, Artificial Sequence
  GFR-binding peptide
  MOD_RES (6)..(7): Xaa is C or S
KASKAXXVPTKLSATSVLYY

SEQ ID NO: 197 - protein, 20 aa, Artificial Sequence
  GFR-binding peptide
  MOD_RES (6)..(7): Xaa is C or S
GSAGPXXTPTKMSATSVLYY

SEQ ID NO: 198 - protein, 20 aa, Artificial Sequence
  GFR-binding peptide
  MOD_RES (6)..(7): Xaa is C or S
AAPASXXVPARLSATSVLYY

SEQ ID NO: 199 - protein, 20 aa, Artificial Sequence
  GFR-binding peptide
  MOD_RES (6)..(7): Xaa is C or S
STPPTXXVPTRLSATSVLYY

SEQ ID NO: 200 - protein, 20 aa, Artificial Sequence
  GFR-binding peptide
  MOD_RES (6)..(7): Xaa is C or S
RVPSTXXAPVKTSATSVLYY

SEQ ID NO: 201 - protein, 20 aa, Artificial Sequence
  GFR-binding peptide
  MOD_RES (6)..(7): Xaa is C or S
ASAAPXXVPQALSATSVLYY

SEQ ID NO: 202 - protein, 20 aa, Artificial Sequence
  GFR-binding peptide
  MOD_RES (6)..(7): Xaa is C or S
ASASPXXVSQDLSATSVLYY

SEQ ID NO: 203 - protein, 20 aa, Artificial Sequence
  GFR-binding peptide
  MOD_RES (6)..(7): Xaa is C or S
ASASPXXVPQDLSATSVLYY

SEQ ID NO: 204 - protein, 20 aa, Artificial Sequence
  GFR-binding peptide
  MOD_RES (7)..(7): Xaa is C or S
NDEGLEXVPTEESATSVLYY

SEQ ID NO: 205 - protein, 20 aa, Artificial Sequence
  GFR-binding peptide
  MOD_RES (7)..(7): Xaa is C or S
NDEGLEXVPTGQSATSVLYY

SEQ ID NO: 206 - protein, 20 aa, Artificial Sequence
  GFR-binding peptide
  MOD_RES (5)..(5): Xaa is C or S
SSVKXQPSRVHHSATSVLYY

SEQ ID NO: 207 - protein, 20 aa, Artificial Sequence
  GFR-binding peptide
  MOD_RES (5)..(5): Xaa is C or S
RNVQXRPTQVQLSATSVLYY

SEQ ID NO: 208 - protein, 20 aa, Artificial Sequence
  GFR-binding peptide
  MOD_RES (6)..(7): Xaa is C or S
GIPEPXXVPTKMSPISVLYK

SEQ ID NO: 209 - protein, 20 aa, Artificial Sequence
  GFR-binding peptide
  MOD_RES (6)..(7): Xaa is C or S
SIPKAXXVPTELSPISVLYK

SEQ ID NO: 210 - protein, 20 aa, Artificial Sequence
  GFR-binding peptide
  MOD_RES (7)..(7): Xaa is C or S
HVTKPTXVPTKLSPISVLYK

SEQ ID NO: 211 - protein, 20 aa, Artificial Sequence
  GFR-binding peptide
  MOD_RES (6)..(7): Xaa is C or S
YVPKPXXVPTKLSPISVLYK

SEQ ID NO: 212 - protein, 20 aa, Artificial Sequence
  GFR-binding peptide
  MOD_RES (6)..(7): Xaa is C or S
TVPKPXXVPTQLSPISVLYK

SEQ ID NO: 213 - protein, 20 aa, Artificial Sequence
  GFR-binding peptide
  MOD_RES (6)..(7): Xaa is C or S
AVPKAXXVPTKLSPISVLYK

SEQ ID NO: 214 - protein, 20 aa, Artificial Sequence
  GFR-binding peptide
  MOD_RES (6)..(7): Xaa is C or S
KASKAXXVPTKLSPISVLYK

SEQ ID NO: 215 - protein, 20 aa, Artificial Sequence
  GFR-binding peptide
  MOD_RES (6)..(7): Xaa is C or S
AAPASXXVPTRLSPISVLYK

SEQ ID NO: 216 - protein, 20 aa, Artificial Sequence
  GFR-binding peptide
  MOD_RES (6)..(7): Xaa is C or S
STPPTXXVPTRLSPISVLYK

SEQ ID NO: 217 - protein, 20 aa, Artificial Sequence
  GFR-binding peptide
  MOD_RES (6)..(7): Xaa is C or S
RVPSTXXVPTKTSPISVLYK

SEQ ID NO: 218 - protein, 20 aa, Artificial Sequence
  GFR-binding peptide
  MOD_RES (6)..(7): Xaa is C or S
ASAAPXXVPTALSPISVLYK

SEQ ID NO: 219 - protein, 20 aa, Artificial Sequence
  GFR-binding peptide
  MOD_RES (6)..(7): Xaa is C or S
ASASPXXVPTDLSPISVLYK

SEQ ID NO: 220 - protein, 20 aa, Artificial Sequence
  GFR-binding peptide
  MOD_RES (6)..(7): Xaa is C or S
ASASPXXVPTDLSPISVLYK

SEQ ID NO: 221 - protein, 20 aa, Artificial Sequence
  GFR-binding peptide
  MOD_RES (6)..(7): Xaa is C or S
GIPEPXXVPEKMSPISVLYK

SEQ ID NO: 222 - protein, 20 aa, Artificial Sequence
  GFR-binding peptide
  MOD_RES (7)..(7): Xaa is C or S
HVTKPTXAPTKLSPISVLYK

SEQ ID NO: 223 - protein, 20 aa, Artificial Sequence
  GFR-binding peptide
  MOD_RES (6)..(7): Xaa is C or S
YVPKPXXAPTKLSPISVLYK

SEQ ID NO: 224 - protein, 20 aa, Artificial Sequence
  GFR-binding peptide
  MOD_RES (6)..(7): Xaa is C or S
TVPKPXXAPTQLSPISVLYK

SEQ ID NO: 225 - protein, 20 aa, Artificial Sequence
  GFR-binding peptide
  MOD_RES (6)..(7): Xaa is C or S
AVPKAXXAPTKLSPISVLYK

SEQ ID NO: 226 - protein, 20 aa, Artificial Sequence
  GFR-binding peptide
  MOD_RES (6)..(7): Xaa is C or S
GSAGPXXTPTKMSPISVLYK

SEQ ID NO: 227 - protein, 20 aa, Artificial Sequence
  GFR-binding peptide
  MOD_RES (6)..(7): Xaa is C or S
AAPASXXVPARLSPISVLYK

SEQ ID NO: 228 - protein, 20 aa, Artificial Sequence
  GFR-binding peptide
  MOD_RES (6)..(7): Xaa is C or S
HVPKPXXAPTKLSPISVLYK

SEQ ID NO: 229 - protein, 20 aa, Artificial Sequence
  GFR-binding peptide
  MOD_RES (6)..(7): Xaa is C or S
RVPSTXXAPVKTSPISVLYK

SEQ ID NO: 230 - protein, 20 aa, Artificial Sequence
  GFR-binding peptide
  MOD_RES (6)..(7): Xaa is C or S
ASAAPXXVPQALSPISVLYK

SEQ ID NO: 231 - protein, 20 aa, Artificial Sequence
  GFR-binding peptide
  MOD_RES (6)..(7): Xaa is C or S
ASASPXXVSQDLSPISVLYK

SEQ ID NO: 232 - protein, 20 aa, Artificial Sequence
  GFR-binding peptide
  MOD_RES (6)..(7): Xaa is C or S
ASASPXXVPQDLSPISVLYK

SEQ ID NO: 233 - protein, 20 aa, Artificial Sequence
  GFR-binding peptide
  MOD_RES (5)..(5): Xaa is C or S
SSVKXQPSRVHHSPISVLYK

SEQ ID NO: 234 - protein, 20 aa, Artificial Sequence
  GFR-binding peptide
  MOD_RES (5)..(5): Xaa is C or S
RNVQXRPTQVQLSPISVLYK

SEQ ID NO: 235 - protein, 20 aa, Artificial Sequence
  GFR-binding peptide
  MOD_RES (6)..(7): Xaa is C or S
KIPKAXXVPTELEPISILYL

SEQ ID NO: 236 - protein, 20 aa, Artificial Sequence
  GFR-binding peptide
  MOD_RES (6)..(7): Xaa is C or S
GIPEPXXVPTKMEPISILYL

SEQ ID NO: 237 - protein, 20 aa, Artificial Sequence
  GFR-binding peptide
  MOD_RES (6)..(7): Xaa is C or S
SIPKAXXVPTELEPISILYL

SEQ ID NO: 238 - protein, 20 aa, Artificial Sequence
  GFR-binding peptide
  MOD_RES (7)..(7): Xaa is C or S
HVTKPTXVPTKLEPISILYL

SEQ ID NO: 239 - protein, 20 aa, Artificial Sequence
  GFR-binding peptide
  MOD_RES (6)..(7): Xaa is C or S
YVPKPXXVPTKLEPISILYL

SEQ ID NO: 240 - protein, 20 aa, Artificial Sequence
  GFR-binding peptide
  MOD_RES (6)..(7): Xaa is C or S
TVPKPXXVPTQLEPISILYL

SEQ ID NO: 241 - protein, 20 aa, Artificial Sequence
  GFR-binding peptide
  MOD_RES (6)..(7): Xaa is C or S
AVPKAXXVPTKLEPISILYL

SEQ ID NO: 242 - protein, 20 aa, Artificial Sequence
  GFR-binding peptide
  MOD_RES (6)..(7): Xaa is C or S
GSAGPXXVPTKMEPISILYL

SEQ ID NO: 243 - protein, 20 aa, Artificial Sequence
  GFR-binding peptide
  MOD_RES (6)..(7): Xaa is C or S
AAPASXXVPTRLEPISILYL

SEQ ID NO: 244 - protein, 20 aa, Artificial Sequence
  GFR-binding peptide
  MOD_RES (6)..(7): Xaa is C or S
STPPTXXVPTRLEPISILYL

SEQ ID NO: 245 - protein, 20 aa, Artificial Sequence
  GFR-binding peptide
  MOD_RES (6)..(7): Xaa is C or S
HVPKPXXVPTKLEPISILYL

SEQ ID NO: 246 - protein, 20 aa, Artificial Sequence
  GFR-binding peptide
  MOD_RES (6)..(7): Xaa is C or S
RVPSTXXVPTKTEPISILYL

SEQ ID NO: 247 - protein, 20 aa, Artificial Sequence
  GFR-binding peptide
  MOD_RES (6)..(7): Xaa is C or S
ASAAPXXVPTALEPISILYL

SEQ ID NO: 248 - protein, 20 aa, Artificial Sequence
  GFR-binding peptide
  MOD_RES (6)..(7): Xaa is C or S
ASASPXXVPTDLEPISILYL

SEQ ID NO: 249 - protein, 20 aa, Artificial Sequence
  GFR-binding peptide
  MOD_RES (6)..(7): Xaa is C or S
ASASPXXVPTDLEPISILYL

SEQ ID NO: 250 - protein, 20 aa, Artificial Sequence
  GFR-binding peptide
  MOD_RES (6)..(7): Xaa is C or S
GIPEPXXVPEKMEPISILYL

SEQ ID NO: 251 - protein, 20 aa, Artificial Sequence
  GFR-binding peptide
  MOD_RES (7)..(7): Xaa is C or S
HVTKPTXAPTKLEPISILYL

SEQ ID NO: 252 - protein, 20 aa, Artificial Sequence
  GFR-binding peptide
  MOD_RES (6)..(7): Xaa is C or S
YVPKPXXAPTKLEPISILYL

SEQ ID NO: 253 - protein, 20 aa, Artificial Sequence
  GFR-binding peptide
  MOD_RES (6)..(7): Xaa is C or S
TVPKPXXAPTQLEPISILYL

SEQ ID NO: 254 - protein, 20 aa, Artificial Sequence
  GFR-binding peptide
  MOD_RES (6)..(7): Xaa is C or S
GSAGPXXTPTKMEPISILYL

SEQ ID NO: 255 - protein, 20 aa, Artificial Sequence
  GFR-binding peptide
  MOD_RES (6)..(7): Xaa is C or S
AAPASXXVPARLEPISILYL

SEQ ID NO: 256 - protein, 20 aa, Artificial Sequence
  GFR-binding peptide
  MOD_RES (6)..(7): Xaa is C or S
ASAAPXXVPQALEPISILYL

SEQ ID NO: 257 - protein, 20 aa, Artificial Sequence
  GFR-binding peptide
  MOD_RES (6)..(7): Xaa is C or S
ASASPXXVSQDLEPISILYL

SEQ ID NO: 258 - protein, 20 aa, Artificial Sequence
  GFR-binding peptide
  MOD_RES (6)..(7): Xaa is C or S
ASASPXXVPQDLEPISILYL

SEQ ID NO: 259 - protein, 20 aa, Artificial Sequence
  GFR-binding peptide
  MOD_RES (5)..(5): Xaa is C or S
SSVKXQPSRVHHEPISILYL

SEQ ID NO: 260 - protein, 20 aa, Artificial Sequence
  GFR-binding peptide
  MOD_RES (5)..(5): Xaa is C or S
RNVQXRPTQVQLEPISILYL

SEQ ID NO: 261 - protein, 20 aa, Artificial Sequence
  GFR-binding peptide
  MOD_RES (7)..(7): Xaa is C or S
HVTKPTXTPTKLSPINMLYF

SEQ ID NO: 262 - protein, 20 aa, Artificial Sequence
  GFR-binding peptide
  MOD_RES (6)..(7): Xaa is C or S
TVPKPXXTPTQLSPINMLYF

SEQ ID NO: 263 - protein, 20 aa, Artificial Sequence
  GFR-binding peptide
  MOD_RES (6)..(7): Xaa is C or S
AVPKAXXTPTKLSPINMLYF

SEQ ID NO: 264 - protein, 20 aa, Artificial Sequence
  GFR-binding peptide
  MOD_RES (6)..(7): Xaa is C or S
KVGKAXXTPTKLSPINMLYF

SEQ ID NO: 265 - protein, 20 aa, Artificial Sequence
  GFR-binding peptide
  MOD_RES (6)..(7): Xaa is C or S
KASKAXXTPTKLSPINMLYF

SEQ ID NO: 266 - protein, 20 aa, Artificial Sequence
  GFR-binding peptide
  MOD_RES (6)..(7): Xaa is C or S
AAPASXXTPTRLSPINMLYF

SEQ ID NO: 267 - protein, 20 aa, Artificial Sequence
  GFR-binding peptide
  MOD_RES (6)..(7): Xaa is C or S
STPPTXXTPTRLSPINMLYF

SEQ ID NO: 268 - protein, 20 aa, Artificial Sequence
  GFR-binding peptide
  MOD_RES (6)..(7): Xaa is C or S
HVPKPXXTPTKLSPINMLYF

SEQ ID NO: 269 - protein, 20 aa, Artificial Sequence
  GFR-binding peptide
  MOD_RES (6)..(7): Xaa is C or S
RVPSTXXTPTKTSPINMLYF

SEQ ID NO: 270 - protein, 20 aa, Artificial Sequence
  GFR-binding peptide
  MOD_RES (6)..(7): Xaa is C or S
ASAAPXXTPTALSPINMLYF

SEQ ID NO: 271 - protein, 20 aa, Artificial Sequence
  GFR-binding peptide
  MOD_RES (6)..(7): Xaa is C or S
ASASPXXTPTDLSPINMLYF

SEQ ID NO: 272 - protein, 20 aa, Artificial Sequence
  GFR-binding peptide
  MOD_RES (6)..(7): Xaa is C or S
ASASPXXTPTDLSPINMLYF

SEQ ID NO: 273 - protein, 20 aa, Artificial Sequence
  GFR-binding peptide
  MOD_RES (6)..(7): Xaa is C or S
KIPKAXXVPTELSPINMLYF

SEQ ID NO: 274 - protein, 20 aa, Artificial Sequence
  GFR-binding peptide
  MOD_RES (6)..(7): Xaa is C or S
GIPEPXXVPEKMSPINMLYF

SEQ ID NO: 275 - protein, 20 aa, Artificial Sequence
  GFR-binding peptide
  MOD_RES (6)..(7): Xaa is C or S
SIPKAXXVPTELSPINMLYF

SEQ ID NO: 276 - protein, 20 aa, Artificial Sequence
  GFR-binding peptide
  MOD_RES (7)..(7): Xaa is C or S
HVTKPTXAPTKLSPINMLYF

SEQ ID NO: 277 - protein, 20 aa, Artificial Sequence
  GFR-binding peptide
  MOD_RES (6)..(7): Xaa is C or S
YVPKPXXAPTKLSPINMLYF

SEQ ID NO: 278 - protein, 20 aa, Artificial Sequence
  GFR-binding peptide
  MOD_RES (6)..(7): Xaa is C or S
TVPKPXXAPTQLSPINMLYF

SEQ ID NO: 279 - protein, 20 aa, Artificial Sequence
  GFR-binding peptide
  MOD_RES (6)..(7): Xaa is C or S
AVPKAXXAPTKLSPINMLYF

SEQ ID NO: 280 - protein, 20 aa, Artificial Sequence
  GFR-binding peptide
  MOD_RES (6)..(7): Xaa is C or S
KVGKAXXVPTKLSPINMLYF

SEQ ID NO: 281 - protein, 20 aa, Artificial Sequence
  GFR-binding peptide
  MOD_RES (6)..(7): Xaa is C or S
KASKAXXVPTKLSPINMLYF

SEQ ID NO: 282 - protein, 20 aa, Artificial Sequence
  GFR-binding peptide
  MOD_RES (6)..(7): Xaa is C or S
AAPASXXVPARLSPINMLYF

SEQ ID NO: 283 - protein, 20 aa, Artificial Sequence
  GFR-binding peptide
  MOD_RES (6)..(7): Xaa is C or S
STPPTXXVPTRLSPINMLYF

SEQ ID NO: 284 - protein, 20 aa, Artificial Sequence
  GFR-binding peptide
  MOD_RES (6)..(7): Xaa is C or S
HVPKPXXAPTKLSPINMLYF

SEQ ID NO: 285 - protein, 20 aa, Artificial Sequence
  GFR-binding peptide
  MOD_RES (6)..(7): Xaa is C or S
RVPSTXXAPVKTSPINMLYF

SEQ ID NO: 286 - protein, 20 aa, Artificial Sequence
  GFR-binding peptide
  MOD_RES (6)..(7): Xaa is C or S
ASAAPXXVPQALSPINMLYF

SEQ ID NO: 287 - protein, 20 aa, Artificial Sequence
  GFR-binding peptide
  MOD_RES (6)..(7): Xaa is C or S
ASASPXXVSQDLSPINMLYF

SEQ ID NO: 288 - protein, 20 aa, Artificial Sequence
  GFR-binding peptide
  MOD_RES (6)..(7): Xaa is C or S
ASASPXXVPQDLSPINMLYF

SEQ ID NO: 289 - protein, 20 aa, Artificial Sequence
  GFR-binding peptide
  MOD_RES (7)..(7): Xaa is C or S
NDEGLEXVPTEESPINMLYF

SEQ ID NO: 290 - protein, 20 aa, Artificial Sequence
  GFR-binding peptide
  MOD_RES (7)..(7): Xaa is C or S
NDEGLEXVPTGQSPINMLYF

SEQ ID NO: 291 - protein, 20 aa, Artificial Sequence
  GFR-binding peptide
  MOD_RES (5)..(5): Xaa is C or S
SSVKXQPSRVHHSPINMLYF

SEQ ID NO: 292 - protein, 20 aa, Artificial Sequence
  GFR-binding peptide
  MOD_RES (5)..(5): Xaa is C or S
RNVQXRPTQVQLSPINMLYF

SEQ ID NO: 293 - protein, 20 aa, Artificial Sequence
  GFR-binding peptide
  MOD_RES (6)..(7): Xaa is C or S
KIPKAXXVPAELSPISILYI

SEQ ID NO: 294 - protein, 20 aa, Artificial Sequence
  GFR-binding peptide
  MOD_RES (6)..(7): Xaa is C or S
SIPKAXXVPAELSPISILYI

SEQ ID NO: 295 - protein, 20 aa, Artificial Sequence
  GFR-binding peptide
  MOD_RES (7)..(7): Xaa is C or S
HVTKPTXVPAKLSPISILYI

SEQ ID NO: 296 - protein, 20 aa, Artificial Sequence
  GFR-binding peptide
  MOD_RES (6)..(7): Xaa is C or S
YVPKPXXVPAKLSPISILYI

SEQ ID NO: 297 - protein, 20 aa, Artificial Sequence
  GFR-binding peptide
  MOD_RES (6)..(7): Xaa is C or S
TVPKPXXVPAQLSPISILYI

SEQ ID NO: 298 - protein, 20 aa, Artificial Sequence
  GFR-binding peptide
  MOD_RES (6)..(7): Xaa is C or S
AVPKAXXVPAKLSPISILYI

SEQ ID NO: 299 - protein, 20 aa, Artificial Sequence
  GFR-binding peptide
  MOD_RES (6)..(7): Xaa is C or S
KVGKAXXVPAKLSPISILYI

SEQ ID NO: 300 - protein, 20 aa, Artificial Sequence
  GFR-binding peptide
  MOD_RES (6)..(7): Xaa is C or S
KASKAXXVPAKLSPISILYI

SEQ ID NO: 301 - protein, 20 aa, Artificial Sequence
  GFR-binding peptide
  MOD_RES (6)..(7): Xaa is C or S
GSAGPXXVPAKMSPISILYI

SEQ ID NO: 302 - protein, 20 aa, Artificial Sequence
  GFR-binding peptide
  MOD_RES (6)..(7): Xaa is C or S
STPPTXXVPARLSPISILYI

SEQ ID NO: 303 - protein, 20 aa, Artificial Sequence
  GFR-binding peptide
  MOD_RES (6)..(7): Xaa is C or S
HVPKPXXVPAKLSPISILYI

SEQ ID NO: 304 - protein, 20 aa, Artificial Sequence
  GFR-binding peptide
  MOD_RES (6)..(7): Xaa is C or S
ASASPXXVPADLSPISILYI

SEQ ID NO: 305 - protein, 20 aa, Artificial Sequence
  GFR-binding peptide
  MOD_RES (6)..(7): Xaa is C or S
ASASPXXVPADLSPISILYI

SEQ ID NO: 306 - protein, 20 aa, Artificial Sequence
  GFR-binding peptide
  MOD_RES (6)..(7): Xaa is C or S
KIPKAXXVPTELSPISILYI

SEQ ID NO: 307 - protein, 20 aa, Artificial Sequence
  GFR-binding peptide
  MOD_RES (6)..(7): Xaa is C or S
GIPEPXXVPEKMSPISILYI

SEQ ID NO: 308 - protein, 20 aa, Artificial Sequence
  GFR-binding peptide
  MOD_RES (6)..(7): Xaa is C or S
SIPKAXXVPTELSPISILYI

SEQ ID NO: 309 - protein, 20 aa, Artificial Sequence
  GFR-binding peptide
  MOD_RES (7)..(7): Xaa is C or S
HVTKPTXAPTKLSPISILYI

SEQ ID NO: 310 - protein, 20 aa, Artificial Sequence
  GFR-binding peptide
  MOD_RES (6)..(7): Xaa is C or S
YVPKPXXAPTKLSPISILYI

SEQ ID NO: 311 - protein, 20 aa, Artificial Sequence
  GFR-binding peptide
  MOD_RES (6)..(7): Xaa is C or S
TVPKPXXAPTQLSPISILYI

SEQ ID NO: 312 - protein, 20 aa, Artificial Sequence
  GFR-binding peptide
  MOD_RES (6)..(7): Xaa is C or S
AVPKAXXAPTKLSPISILYI

SEQ ID NO: 313 - protein, 20 aa, Artificial Sequence
  GFR-binding peptide
  MOD_RES (6)..(7): Xaa is C or S
KVGKAXXVPTKLSPISILYI

SEQ ID NO: 314 - protein, 20 aa, Artificial Sequence
  GFR-binding peptide
  MOD_RES (6)..(7): Xaa is C or S
KASKAXXVPTKLSPISILYI

SEQ ID NO: 315 - protein, 20 aa, Artificial Sequence
  GFR-binding peptide
  MOD_RES (6)..(7): Xaa is C or S
GSAGPXXTPTKMSPISILYI

SEQ ID NO: 316 - protein, 20 aa, Artificial Sequence
  GFR-binding peptide
  MOD_RES (6)..(7): Xaa is C or S
STPPTXXVPTRLSPISILYI

SEQ ID NO: 317 - protein, 20 aa, Artificial Sequence
  GFR-binding peptide
  MOD_RES (6)..(7): Xaa is C or S
HVPKPXXAPTKLSPISILYI

SEQ ID NO: 318 - protein, 20 aa, Artificial Sequence
  GFR-binding peptide
  MOD_RES (6)..(7): Xaa is C or S
RVPSTXXAPVKTSPISILYI

SEQ ID NO: 319 - protein, 20 aa, Artificial Sequence
  GFR-binding peptide
  MOD_RES (6)..(7): Xaa is C or S
ASAAPXXVPQALSPISILYI

SEQ ID NO: 320 - protein, 20 aa, Artificial Sequence
  GFR-binding peptide
  MOD_RES (6)..(7): Xaa is C or S
ASASPXXVSQDLSPISILYI

SEQ ID NO: 321 - protein, 20 aa, Artificial Sequence
  GFR-binding peptide
  MOD_RES (6)..(7): Xaa is C or S
ASASPXXVPQDLSPISILYI

SEQ ID NO: 322 - protein, 20 aa, Artificial Sequence
  GFR-binding peptide
  MOD_RES (7)..(7): Xaa is C or S
NDEGLEXVPTGQSPISILYI

SEQ ID NO: 323 - protein, 20 aa, Artificial Sequence
  GFR-binding peptide
  MOD_RES (5)..(5): Xaa is C or S
SSVKXQPSRVHHSPISILYI

SEQ ID NO: 324 - protein, 20 aa, Artificial Sequence
  GFR-binding peptide
  MOD_RES (5)..(5): Xaa is C or S
RNVQXRPTQVQLSPISILYI

SEQ ID NO: 325 - protein, 20 aa, Artificial Sequence
  GFR-binding peptide
  MOD_RES (6)..(7): Xaa is C or S
KIPKAXXVPTELSPISILFI

SEQ ID NO: 326 - protein, 20 aa, Artificial Sequence
  GFR-binding peptide
  MOD_RES (6)..(7): Xaa is C or S
GIPEPXXVPTKMSPISILFI

SEQ ID NO: 327 - protein, 20 aa, Artificial Sequence
  GFR-binding peptide
  MOD_RES (6)..(7): Xaa is C or S
SIPKAXXVPTELSPISILFI

SEQ ID NO: 328 - protein, 20 aa, Artificial Sequence
  GFR-binding peptide
  MOD_RES (7)..(7): Xaa is C or S
HVTKPTXVPTKLSPISILFI

SEQ ID NO: 329 - protein, 20 aa, Artificial Sequence
  GFR-binding peptide
  MOD_RES (6)..(7): Xaa is C or S
YVPKPXXVPTKLSPISILFI

SEQ ID NO: 330 - protein, 20 aa, Artificial Sequence
  GFR-binding peptide
  MOD_RES (6)..(7): Xaa is C or S
TVPKPXXVPTQLSPISILFI

SEQ ID NO: 331 - protein, 20 aa, Artificial Sequence
  GFR-binding peptide
  MOD_RES (6)..(7): Xaa is C or S
AVPKAXXVPTKLSPISILFI

SEQ ID NO: 332 - protein, 20 aa, Artificial Sequence
  GFR-binding peptide
  MOD_RES (6)..(7): Xaa is C or S
KVGKAXXVPTKLSPISILFI

SEQ ID NO: 333 - protein, 20 aa, Artificial Sequence
  GFR-binding peptide
  MOD_RES (6)..(7): Xaa is C or S
KASKAXXVPTKLSPISILFI

SEQ ID NO: 334 - protein, 20 aa, Artificial Sequence
  GFR-binding peptide
  MOD_RES (6)..(7): Xaa is C or S
GSAGPXXVPTKMSPISILFI

SEQ ID NO: 335 - protein, 20 aa, Artificial Sequence
  GFR-binding peptide
  MOD_RES (6)..(7): Xaa is C or S
AAPASXXVPTRLSPISILFI

SEQ ID NO: 336 - protein, 20 aa, Artificial Sequence
  GFR-binding peptide
  MOD_RES (6)..(7): Xaa is C or S
HVPKPXXVPTKLSPISILFI

SEQ ID NO: 337 - protein, 20 aa, Artificial Sequence
  GFR-binding peptide
  MOD_RES (6)..(7): Xaa is C or S
RVPSTXXVPTKTSPISILFI

SEQ ID NO: 338 - protein, 20 aa, Artificial Sequence
  GFR-binding peptide
  MOD_RES (6)..(7): Xaa is C or S
ASAAPXXVPTALSPISILFI

SEQ ID NO: 339 - protein, 20 aa, Artificial Sequence
  GFR-binding peptide
  MOD_RES (6)..(7): Xaa is C or S
ASASPXXVPTDLSPISILFI

SEQ ID NO: 340 - protein, 20 aa, Artificial Sequence
  GFR-binding peptide
  MOD_RES (6)..(7): Xaa is C or S
ASASPXXVPTDLSPISILFI

SEQ ID NO: 341 - protein, 20 aa, Artificial Sequence
  GFR-binding peptide
  MOD_RES (6)..(7): Xaa is C or S
GIPEPXXVPEKMSPISILFI

SEQ ID NO: 342 - protein, 20 aa, Artificial Sequence
  GFR-binding peptide
  MOD_RES (7)..(7): Xaa is C or S
HVTKPTXAPTKLSPISILFI

SEQ ID NO: 343 - protein, 20 aa, Artificial Sequence
  GFR-binding peptide
  MOD_RES (6)..(7): Xaa is C or S
YVPKPXXAPTKLSPISILFI

SEQ ID NO: 344 - protein, 20 aa, Artificial Sequence
  GFR-binding peptide
  MOD_RES (6)..(7): Xaa is C or S
TVPKPXXAPTQLSPISILFI

SEQ ID NO: 345 - protein, 20 aa, Artificial Sequence
  GFR-binding peptide
  MOD_RES (6)..(7): Xaa is C or S
AVPKAXXAPTKLSPISILFI

SEQ ID NO: 346 - protein, 20 aa, Artificial Sequence
  GFR-binding peptide
  MOD_RES (6)..(7): Xaa is C or S
GSAGPXXTPTKMSPISILFI

SEQ ID NO: 347 - protein, 20 aa, Artificial Sequence
  GFR-binding peptide
  MOD_RES (6)..(7): Xaa is C or S
AAPASXXVPARLSPISILFI

SEQ ID NO: 348 - protein, 20 aa, Artificial Sequence
  GFR-binding peptide
  MOD_RES (6)..(7): Xaa is C or S
HVPKPXXAPTKLSPISILFI

SEQ ID NO: 349 - protein, 20 aa, Artificial Sequence
  GFR-binding peptide
  MOD_RES (6)..(7): Xaa is C or S
RVPSTXXAPVKTSPISILFI

SEQ ID NO: 350 - protein, 20 aa, Artificial Sequence
  GFR-binding peptide
  MOD_RES (6)..(7): Xaa is C or S
ASAAPXXVPQALSPISILFI

SEQ ID NO: 351 - protein, 20 aa, Artificial Sequence
  GFR-binding peptide
  MOD_RES (6)..(7): Xaa is C or S
ASASPXXVSQDLSPISILFI

SEQ ID NO: 352 - protein, 20 aa, Artificial Sequence
  GFR-binding peptide
  MOD_RES (6)..(7): Xaa is C or S
ASASPXXVPQDLSPISILFI

SEQ ID NO: 353 - protein, 20 aa, Artificial Sequence
  GFR-binding peptide
  MOD_RES (6)..(7): Xaa is C or S
KIPKAXXAPVELKPLSMLYV

SEQ ID NO: 354 - protein, 20 aa, Artificial Sequence
  GFR-binding peptide
  MOD_RES (6)..(7): Xaa is C or S
GIPEPXXAPVKMKPLSMLYV

SEQ ID NO: 355 - protein, 20 aa, Artificial Sequence
  GFR-binding peptide
  MOD_RES (6)..(7): Xaa is C or S
SIPKAXXAPVELKPLSMLYV

SEQ ID NO: 356 - protein, 20 aa, Artificial Sequence
  GFR-binding peptide
  MOD_RES (7)..(7): Xaa is C or S
HVTKPTXAPVKLKPLSMLYV

SEQ ID NO: 357 - protein, 20 aa, Artificial Sequence
  GFR-binding peptide
  MOD_RES (6)..(7): Xaa is C or S
YVPKPXXAPVKLKPLSMLYV

SEQ ID NO: 358 - protein, 20 aa, Artificial Sequence
  GFR-binding peptide
  MOD_RES (6)..(7): Xaa is C or S
TVPKPXXAPVQLKPLSMLYV

SEQ ID NO: 359 - protein, 20 aa, Artificial Sequence
  GFR-binding peptide
  MOD_RES (6)..(7): Xaa is C or S
AVPKAXXAPVKLKPLSMLYV

SEQ ID NO: 360 - protein, 20 aa, Artificial Sequence
  GFR-binding peptide
  MOD_RES (6)..(7): Xaa is C or S
KVGKAXXAPVKLKPLSMLYV

SEQ ID NO: 361 - protein, 20 aa, Artificial Sequence
  GFR-binding peptide
  MOD_RES (6)..(7): Xaa is C or S
KASKAXXAPVKLKPLSMLYV

SEQ ID NO: 362 - protein, 20 aa, Artificial Sequence
  GFR-binding peptide
  MOD_RES (6)..(7): Xaa is C or S
GSAGPXXAPVKMKPLSMLYV

SEQ ID NO: 363 - protein, 20 aa, Artificial Sequence
  GFR-binding peptide
  MOD_RES (6)..(7): Xaa is C or S
AAPASXXAPVRLKPLSMLYV

SEQ ID NO: 364 - protein, 20 aa, Artificial Sequence
  GFR-binding peptide
  MOD_RES (6)..(7): Xaa is C or S
STPPTXXAPVRLKPLSMLYV

SEQ ID NO: 365 - protein, 20 aa, Artificial Sequence
  GFR-binding peptide
  MOD_RES (6)..(7): Xaa is C or S
HVPKPXXAPVKLKPLSMLYV

SEQ ID NO: 366 - protein, 20 aa, Artificial Sequence
  GFR-binding peptide
  MOD_RES (6)..(7): Xaa is C or S
ASAAPXXAPVALKPLSMLYV

SEQ ID NO: 367 - protein, 20 aa, Artificial Sequence
  GFR-binding peptide
  MOD_RES (6)..(7): Xaa is C or S
ASASPXXAPVDLKPLSMLYV

SEQ ID NO: 368 - protein, 20 aa, Artificial Sequence
  GFR-binding peptide
  MOD_RES (6)..(7): Xaa is C or S
ASASPXXAPVDLKPLSMLYV

SEQ ID NO: 369 - protein, 20 aa, Artificial Sequence
  GFR-binding peptide
  MOD_RES (6)..(7): Xaa is C or S
KIPKAXXVPTELKPLSMLYV

SEQ ID NO: 370 - protein, 20 aa, Artificial Sequence
  GFR-binding peptide
  MOD_RES (6)..(7): Xaa is C or S
GIPEPXXVPEKMKPLSMLYV

SEQ ID NO: 371 - protein, 20 aa, Artificial Sequence
  GFR-binding peptide
  MOD_RES (6)..(7): Xaa is C or S
SIPKAXXVPTELKPLSMLYV

SEQ ID NO: 372 - protein, 20 aa, Artificial Sequence
  GFR-binding peptide
  MOD_RES (7)..(7): Xaa is C or S
HVTKPTXAPTKLKPLSMLYV

SEQ ID NO: 373 - protein, 20 aa, Artificial Sequence
  GFR-binding peptide
  MOD_RES (6)..(7): Xaa is C or S
YVPKPXXAPTKLKPLSMLYV

SEQ ID NO: 374 - protein, 20 aa, Artificial Sequence
  GFR-binding peptide
  MOD_RES (6)..(7): Xaa is C or S
TVPKPXXAPTQLKPLSMLYV

SEQ ID NO: 375 - protein, 20 aa, Artificial Sequence
  GFR-binding peptide
  MOD_RES (6)..(7): Xaa is C or S
AVPKAXXAPTKLKPLSMLYV

SEQ ID NO: 376 - protein, 20 aa, Artificial Sequence
  GFR-binding peptide
  MOD_RES (6)..(7): Xaa is C or S
KVGKAXXVPTKLKPLSMLYV

SEQ ID NO: 377 - protein, 20 aa, Artificial Sequence
  GFR-binding peptide
  MOD_RES (6)..(7): Xaa is C or S
KASKAXXVPTKLKPLSMLYV

SEQ ID NO: 378 - protein, 20 aa, Artificial Sequence
  GFR-binding peptide
  MOD_RES (6)..(7): Xaa is C or S
GSAGPXXTPTKMKPLSMLYV

SEQ ID NO: 379 - protein, 20 aa, Artificial Sequence
  GFR-binding peptide
  MOD_RES (6)..(7): Xaa is C or S
AAPASXXVPARLKPLSMLYV

SEQ ID NO: 380 - protein, 20 aa, Artificial Sequence
  GFR-binding peptide
  MOD_RES (6)..(7): Xaa is C or S
STPPTXXVPTRLKPLSMLYV

SEQ ID NO: 381 - protein, 20 aa, Artificial Sequence
  GFR-binding peptide
  MOD_RES (6)..(7): Xaa is C or S
HVPKPXXAPTKLKPLSMLYV

SEQ ID NO: 382 - protein, 20 aa, Artificial Sequence
  GFR-binding peptide
  MOD_RES (6)..(7): Xaa is C or S
ASAAPXXVPQALKPLSMLYV

SEQ ID NO: 383 - protein, 20 aa, Artificial Sequence
  GFR-binding peptide
  MOD_RES (6)..(7): Xaa is C or S
ASASPXXVSQDLKPLSMLYV

SEQ ID NO: 384 - protein, 20 aa, Artificial Sequence
  GFR-binding peptide
  MOD_RES (6)..(7): Xaa is C or S
ASASPXXVPQDLKPLSMLYV

SEQ ID NO: 385 - protein, 20 aa, Artificial Sequence
  GFR-binding peptide
  MOD_RES (7)..(7): Xaa is C or S
NDEGLEXVPTEEKPLSMLYV

SEQ ID NO: 386 - protein, 20 aa, Artificial Sequence
  GFR-binding peptide
  MOD_RES (7)..(7): Xaa is C or S
NDEGLEXVPTGQKPLSMLYV

SEQ ID NO: 387 - protein, 20 aa, Artificial Sequence
  GFR-binding peptide
  MOD_RES (7)..(7): Xaa is C or S
HVTKPTXVPQKLEPLPIVYY

SEQ ID NO: 388 - protein, 20 aa, Artificial Sequence
  GFR-binding peptide
  MOD_RES (6)..(7): Xaa is C or S
YVPKPXXVPQKLEPLPIVYY

SEQ ID NO: 389 - protein, 20 aa, Artificial Sequence
  GFR-binding peptide
  MOD_RES (6)..(7): Xaa is C or S
TVPKPXXVPQQLEPLPIVYY

SEQ ID NO: 390 - protein, 20 aa, Artificial Sequence
  GFR-binding peptide
  MOD_RES (6)..(7): Xaa is C or S
AVPKAXXVPQKLEPLPIVYY

SEQ ID NO: 391 - protein, 20 aa, Artificial Sequence
  GFR-binding peptide
  MOD_RES (6)..(7): Xaa is C or S
GSAGPXXVPQKMEPLPIVYY

SEQ ID NO: 392 - protein, 20 aa, Artificial Sequence
  GFR-binding peptide
  MOD_RES (6)..(7): Xaa is C or S
AAPASXXVPQRLEPLPIVYY

SEQ ID NO: 393 - protein, 20 aa, Artificial Sequence
  GFR-binding peptide
  MOD_RES (6)..(7): Xaa is C or S
STPPTXXVPQRLEPLPIVYY

SEQ ID NO: 394 - protein, 20 aa, Artificial Sequence
  GFR-binding peptide
  MOD_RES (6)..(7): Xaa is C or S
HVPKPXXVPQKLEPLPIVYY

SEQ ID NO: 395 - protein, 20 aa, Artificial Sequence
  GFR-binding peptide
  MOD_RES (6)..(7): Xaa is C or S
RVPSTXXVPQKTEPLPIVYY

SEQ ID NO: 396 - protein, 20 aa, Artificial Sequence
  GFR-binding peptide
  MOD_RES (6)..(7): Xaa is C or S
ASASPXXVPQDLEPLPIVYY

SEQ ID NO: 397 - protein, 20 aa, Artificial Sequence
  GFR-binding peptide
  MOD_RES (6)..(7): Xaa is C or S
ASASPXXVPQDLEPLPIVYY

SEQ ID NO: 398 - protein, 20 aa, Artificial Sequence
  GFR-binding peptide
  MOD_RES (6)..(7): Xaa is C or S
KIPKAXXVPTELEPLPIVYY

SEQ ID NO: 399 - protein, 20 aa, Artificial Sequence
  GFR-binding peptide
  MOD_RES (6)..(7): Xaa is C or S
GIPEPXXVPEKMEPLPIVYY

SEQ ID NO: 400 - protein, 20 aa, Artificial Sequence
  GFR-binding peptide
  MOD_RES (6)..(7): Xaa is C or S
SIPKAXXVPTELEPLPIVYY

SEQ ID NO: 401 - protein, 20 aa, Artificial Sequence
  GFR-binding peptide
  MOD_RES (7)..(7): Xaa is C or S
HVTKPTXAPTKLEPLPIVYY

SEQ ID NO: 402 - protein, 20 aa, Artificial Sequence
  GFR-binding peptide
  MOD_RES (6)..(7): Xaa is C or S
YVPKPXXAPTKLEPLPIVYY

SEQ ID NO: 403 - protein, 20 aa, Artificial Sequence
  GFR-binding peptide
  MOD_RES (6)..(7): Xaa is C or S
TVPKPXXAPTQLEPLPIVYY

SEQ ID NO: 404 - protein, 20 aa, Artificial Sequence
  GFR-binding peptide
  MOD_RES (6)..(7): Xaa is C or S
KVGKAXXVPTKLEPLPIVYY

SEQ ID NO: 405 - protein, 20 aa, Artificial Sequence
  GFR-binding peptide
  MOD_RES (6)..(7): Xaa is C or S
KASKAXXVPTKLEPLPIVYY

SEQ ID NO: 406 - protein, 20 aa, Artificial Sequence
  GFR-binding peptide
  MOD_RES (6)..(7): Xaa is C or S
GSAGPXXTPTKMEPLPIVYY

SEQ ID NO: 407 - protein, 20 aa, Artificial Sequence
  GFR-binding peptide
  MOD_RES (6)..(7): Xaa is C or S
AAPASXXVPARLEPLPIVYY

SEQ ID NO: 408 - protein, 20 aa, Artificial Sequence
  GFR-binding peptide
  MOD_RES (6)..(7): Xaa is C or S
STPPTXXVPTRLEPLPIVYY

SEQ ID NO: 409 - protein, 20 aa, Artificial Sequence
  GFR-binding peptide
  MOD_RES (6)..(7): Xaa is C or S
HVPKPXXAPTKLEPLPIVYY

SEQ ID NO: 410 - protein, 20 aa, Artificial Sequence
  GFR-binding peptide
  MOD_RES (6)..(7): Xaa is C or S
RVPSTXXAPVKTEPLPIVYY

SEQ ID NO: 411 - protein, 20 aa, Artificial Sequence
  GFR-binding peptide
  MOD_RES (6)..(7): Xaa is C or S
ASASPXXVSQDLEPLPIVYY

SEQ ID NO: 412 - protein, 20 aa, Artificial Sequence
  GFR-binding peptide
  MOD_RES (7)..(7): Xaa is C or S
NDEGLEXVPTEEEPLPIVYY

SEQ ID NO: 413 - protein, 20 aa, Artificial Sequence
  GFR-binding peptide
  MOD_RES (7)..(7): Xaa is C or S
NDEGLEXVPTGQEPLPIVYY

SEQ ID NO: 414 - protein, 20 aa, Artificial Sequence
  GFR-binding peptide
  MOD_RES (5)..(5): Xaa is C or S
SSVKXQPSRVHHEPLPIVYY

SEQ ID NO: 415 - protein, 20 aa, Artificial Sequence
  GFR-binding peptide
  MOD_RES (5)..(5): Xaa is C or S
RNVQXRPTQVQLEPLPIVYY

SEQ ID NO: 416 - protein, 20 aa, Artificial Sequence
  GFR-binding peptide
  MOD_RES (6)..(7): Xaa is C or S
GIPEPXXVSQKMEPLTILYY

SEQ ID NO: 417 - protein, 20 aa, Artificial Sequence
  GFR-binding peptide
  MOD_RES (6)..(7): Xaa is C or S
SIPKAXXVSQELEPLTILYY

SEQ ID NO: 418 - protein, 20 aa, Artificial Sequence
  GFR-binding peptide
  MOD_RES (7)..(7): Xaa is C or S
HVTKPTXVSQKLEPLTILYY

SEQ ID NO: 419 - protein, 20 aa, Artificial Sequence
  GFR-binding peptide
  MOD_RES (6)..(7): Xaa is C or S
YVPKPXXVSQKLEPLTILYY

SEQ ID NO: 420 - protein, 20 aa, Artificial Sequence
  GFR-binding peptide
  MOD_RES (6)..(7): Xaa is C or S
TVPKPXXVSQQLEPLTILYY

SEQ ID NO: 421 - protein, 20 aa, Artificial Sequence
  GFR-binding peptide
  MOD_RES (6)..(7): Xaa is C or S
AVPKAXXVSQKLEPLTILYY

SEQ ID NO: 422 - protein, 20 aa, Artificial Sequence
  GFR-binding peptide
  MOD_RES (6)..(7): Xaa is C or S
KASKAXXVSQKLEPLTILYY

SEQ ID NO: 423 - protein, 20 aa, Artificial Sequence
  GFR-binding peptide
  MOD_RES (6)..(7): Xaa is C or S
GSAGPXXVSQKMEPLTILYY

SEQ ID NO: 424 - protein, 20 aa, Artificial Sequence
  GFR-binding peptide
  MOD_RES (6)..(7): Xaa is C or S
AAPASXXVSQRLEPLTILYY

SEQ ID NO: 425 - protein, 20 aa, Artificial Sequence
  GFR-binding peptide
  MOD_RES (6)..(7): Xaa is C or S
STPPTXXVSQRLEPLTILYY

SEQ ID NO: 426 - protein, 20 aa, Artificial Sequence
  GFR-binding peptide
  MOD_RES (6)..(7): Xaa is C or S
HVPKPXXVSQKLEPLTILYY

SEQ ID NO: 427 - protein, 20 aa, Artificial Sequence
  GFR-binding peptide
  MOD_RES (6)..(7): Xaa is C or S
RVPSTXXVSQKTEPLTILYY

SEQ ID NO: 428 - protein, 20 aa, Artificial Sequence
  GFR-binding peptide
  MOD_RES (6)..(7): Xaa is C or S
ASAAPXXVSQALEPLTILYY

SEQ ID NO: 429 - protein, 20 aa, Artificial Sequence
  GFR-binding peptide
  MOD_RES (6)..(7): Xaa is C or S
KIPKAXXVPTELEPLTILYY

SEQ ID NO: 430 - protein, 20 aa, Artificial Sequence
  GFR-binding peptide
  MOD_RES (6)..(7): Xaa is C or S
GIPEPXXVPEKMEPLTILYY

SEQ ID NO: 431 - protein, 20 aa, Artificial Sequence
  GFR-binding peptide
  MOD_RES (6)..(7): Xaa is C or S
SIPKAXXVPTELEPLTILYY

SEQ ID NO: 432 - protein, 20 aa, Artificial Sequence
  GFR-binding peptide
  MOD_RES (7)..(7): Xaa is C or S
HVTKPTXAPTKLEPLTILYY

SEQ ID NO: 433 - protein, 20 aa, Artificial Sequence
  GFR-binding peptide
  MOD_RES (6)..(7): Xaa is C or S
YVPKPXXAPTKLEPLTILYY

SEQ ID NO: 434 - protein, 20 aa, Artificial Sequence
  GFR-binding peptide
  MOD_RES (6)..(7): Xaa is C or S
TVPKPXXAPTQLEPLTILYY

SEQ ID NO: 435 - protein, 20 aa, Artificial Sequence
  GFR-binding peptide
  MOD_RES (6)..(7): Xaa is C or S
AVPKAXXAPTKLEPLTILYY

SEQ ID NO: 436 - protein, 20 aa, Artificial Sequence
  GFR-binding peptide
  MOD_RES (6)..(7): Xaa is C or S
KASKAXXVPTKLEPLTILYY

SEQ ID NO: 437 - protein, 20 aa, Artificial Sequence
  GFR-binding peptide
  MOD_RES (6)..(7): Xaa is C or S
GSAGPXXTPTKMEPLTILYY

SEQ ID NO: 438 - protein, 20 aa, Artificial Sequence
  GFR-binding peptide
  MOD_RES (6)..(7): Xaa is C or S
AAPASXXVPARLEPLTILYY

SEQ ID NO: 439 - protein, 20 aa, Artificial Sequence
  GFR-binding peptide
  MOD_RES (6)..(7): Xaa is C or S
STPPTXXVPTRLEPLTILYY

SEQ ID NO: 440 - protein, 20 aa, Artificial Sequence
  GFR-binding peptide
  MOD_RES (6)..(7): Xaa is C or S
HVPKPXXAPTKLEPLTILYY

SEQ ID NO: 441 - protein, 20 aa, Artificial Sequence
  GFR-binding peptide
  MOD_RES (6)..(7): Xaa is C or S
RVPSTXXAPVKTEPLTILYY

SEQ ID NO: 442 - protein, 20 aa, Artificial Sequence
  GFR-binding peptide
  MOD_RES (7)..(7): Xaa is C or S
NDEGLEXVPTGQEPLTILYY

SEQ ID NO: 443 - protein, 20 aa, Artificial Sequence
  GFR-binding peptide
  MOD_RES (5)..(5): Xaa is C or S
SSVKXQPSRVHHEPLTILYY

SEQ ID NO: 444 - protein, 20 aa, Artificial Sequence
  GFR-binding peptide
  MOD_RES (5)..(5): Xaa is C or S
RNVQXRPTQVQLEPLTILYY

SEQ ID NO: 445 - protein, 20 aa, Artificial Sequence
  GFR-binding peptide
  MOD_RES (6)..(7): Xaa is C or S
KIPKAXXVPQELEPLTILYY

SEQ ID NO: 446 - protein, 20 aa, Artificial Sequence
  GFR-binding peptide
  MOD_RES (6)..(7): Xaa is C or S
GIPEPXXVPQKMEPLTILYY

SEQ ID NO: 447 - protein, 20 aa, Artificial Sequence
  GFR-binding peptide
  MOD_RES (6)..(7): Xaa is C or S
SIPKAXXVPQELEPLTILYY

SEQ ID NO: 448 - protein, 20 aa, Artificial Sequence
  GFR-binding peptide
  MOD_RES (7)..(7): Xaa is C or S
HVTKPTXVPQKLEPLTILYY

SEQ ID NO: 449 - protein, 20 aa, Artificial Sequence
  GFR-binding peptide
  MOD_RES (6)..(7): Xaa is C or S
YVPKPXXVPQKLEPLTILYY

SEQ ID NO: 450 - protein, 20 aa, Artificial Sequence
  GFR-binding peptide
  MOD_RES (6)..(7): Xaa is C or S
TVPKPXXVPQQLEPLTILYY

SEQ ID NO: 451 - protein, 20 aa, Artificial Sequence
  GFR-binding peptide
  MOD_RES (6)..(7): Xaa is C or S
AVPKAXXVPQKLEPLTILYY

SEQ ID NO: 452 - protein, 20 aa, Artificial Sequence
  GFR-binding peptide
  MOD_RES (6)..(7): Xaa is C or S
KVGKAXXVPQKLEPLTILYY

SEQ ID NO: 453 - protein, 20 aa, Artificial Sequence
  GFR-binding peptide
  MOD_RES (6)..(7): Xaa is C or S
KASKAXXVPQKLEPLTILYY

SEQ ID NO: 454 - protein, 20 aa, Artificial Sequence
  GFR-binding peptide
  MOD_RES (6)..(7): Xaa is C or S
GSAGPXXVPQKMEPLTILYY

SEQ ID NO: 455 - protein, 20 aa, Artificial Sequence
  GFR-binding peptide
  MOD_RES (6)..(7): Xaa is C or S
AAPASXXVPQRLEPLTILYY

SEQ ID NO: 456 - protein, 20 aa, Artificial Sequence
  GFR-binding peptide
  MOD_RES (6)..(7): Xaa is C or S
STPPTXXVPQRLEPLTILYY

SEQ ID NO: 457 - protein, 20 aa, Artificial Sequence
  GFR-binding peptide
  MOD_RES (6)..(7): Xaa is C or S
HVPKPXXVPQKLEPLTILYY

SEQ ID NO: 458 - protein, 20 aa, Artificial Sequence
  GFR-binding peptide
  MOD_RES (6)..(7): Xaa is C or S
RVPSTXXVPQKTEPLTILYY

SEQ ID NO: 459 - protein, 20 aa, Artificial Sequence
  GFR-binding peptide
  MOD_RES (6)..(7): Xaa is C or S
ASASPXXVPQDLEPLTILYY

SEQ ID NO: 460 - protein, 20 aa, Artificial Sequence
  GFR-binding peptide
  MOD_RES (7)..(7): Xaa is C or S
NDEGLEXVPTGQSNITMQIM

SEQ ID NO: 461 - protein, 20 aa, Artificial Sequence
  GFR-binding peptide
  MOD_RES (6)..(7): Xaa is C or S
GIPEPXXVPEKMSNITMQIM

SEQ ID NO: 462 - protein, 20 aa, Artificial Sequence
  GFR-binding peptide
  MOD_RES (7)..(7): Xaa is C or S
HVTKPTXAPTKLSNITMQIM

SEQ ID NO: 463 - protein, 20 aa, Artificial Sequence
  GFR-binding peptide
  MOD_RES (6)..(7): Xaa is C or S
YVPKPXXAPTKLSNITMQIM

SEQ ID NO: 464 - protein, 20 aa, Artificial Sequence
  GFR-binding peptide
  MOD_RES (6)..(7): Xaa is C or S
TVPKPXXAPTQLSNITMQIM

SEQ ID NO: 465 - protein, 20 aa, Artificial Sequence
  GFR-binding peptide
  MOD_RES (6)..(7): Xaa is C or S
AVPKAXXAPTKLSNITMQIM

SEQ ID NO: 466 - protein, 20 aa, Artificial Sequence
  GFR-binding peptide
  MOD_RES (6)..(7): Xaa is C or S
HVPKPXXAPTKLSNITMQIM

SEQ ID NO: 467 - protein, 20 aa, Artificial Sequence
  GFR-binding peptide
  MOD_RES (6)..(7): Xaa is C or S
RVPSTXXAPVKTSNITMQIM

SEQ ID NO: 468 - protein, 20 aa, Artificial Sequence
  GFR-binding peptide
  MOD_RES (6)..(7): Xaa is C or S
ASAAPXXVPQALSNITMQIM

SEQ ID NO: 469 - protein, 20 aa, Artificial Sequence
  GFR-binding peptide
  MOD_RES (6)..(7): Xaa is C or S
ASASPXXVSQDLSNITMQIM

SEQ ID NO: 470 - protein, 20 aa, Artificial Sequence
  GFR-binding peptide
  MOD_RES (6)..(7): Xaa is C or S
ASASPXXVPQDLSNITMQIM

SEQ ID NO: 471 - protein, 20 aa, Artificial Sequence
  GFR-binding peptide
  MOD_RES (5)..(5): Xaa is C or S
SSVKXQPSRVHHSNITMQIM

SEQ ID NO: 472 - protein, 20 aa, Artificial Sequence
  GFR-binding peptide
  MOD_RES (5)..(5): Xaa is C or S
RNVQXRPTQVQLSNITMQIM

SEQ ID NO: 473 - protein, 20 aa, Artificial Sequence
  GFR-binding peptide
  MOD_RES (5)..(5): Xaa is C or S
RNVQXRPSRVQLRSVKVAKV

SEQ ID NO: 474 - protein, 20 aa, Artificial Sequence
  GFR-binding peptide
  MOD_RES (6)..(7): Xaa is C or S
KIPKAXXVPTELRSVKVAKV

SEQ ID NO: 475 - protein, 20 aa, Artificial Sequence
  GFR-binding peptide
  MOD_RES (6)..(7): Xaa is C or S
GIPEPXXVPEKMRSVKVAKV

SEQ ID NO: 476 - protein, 20 aa, Artificial Sequence
  GFR-binding peptide
  MOD_RES (6)..(7): Xaa is C or S
YVPKPXXAPTKLRSVKVAKV

SEQ ID NO: 477 - protein, 20 aa, Artificial Sequence
  GFR-binding peptide
  MOD_RES (6)..(7): Xaa is C or S
AVPKAXXAPTKLRSVKVAKV

SEQ ID NO: 478 - protein, 20 aa, Artificial Sequence
  GFR-binding peptide
  MOD_RES (6)..(7): Xaa is C or S
KVGKAXXVPTKLRSVKVAKV

SEQ ID NO: 479 - protein, 20 aa, Artificial Sequence
  GFR-binding peptide
  MOD_RES (6)..(7): Xaa is C or S
KASKAXXVPTKLRSVKVAKV

SEQ ID NO: 480 - protein, 20 aa, Artificial Sequence
  GFR-binding peptide
  MOD_RES (6)..(7): Xaa is C or S
GSAGPXXTPTKMRSVKVAKV

SEQ ID NO: 481 - protein, 20 aa, Artificial Sequence
  GFR-binding peptide
  MOD_RES (6)..(7): Xaa is C or S
AAPASXXVPARLRSVKVAKV

SEQ ID NO: 482 - protein, 20 aa, Artificial Sequence
  GFR-binding peptide
  MOD_RES (6)..(7): Xaa is C or S
STPPTXXVPTRLRSVKVAKV

SEQ ID NO: 483 - protein, 20 aa, Artificial Sequence
  GFR-binding peptide
  MOD_RES (6)..(7): Xaa is C or S
HVPKPXXAPTKLRSVKVAKV

SEQ ID NO: 484 - protein, 20 aa, Artificial Sequence
  GFR-binding peptide
  MOD_RES (6)..(7): Xaa is C or S
RVPSTXXAPVKTRSVKVAKV

SEQ ID NO: 485 - protein, 20 aa, Artificial Sequence
  GFR-binding peptide
  MOD_RES (6)..(7): Xaa is C or S
ASASPXXVSQDLRSVKVAKV

SEQ ID NO: 486 - protein, 20 aa, Artificial Sequence
  GFR-binding peptide
  MOD_RES (7)..(7): Xaa is C or S
NDEGLEXVPTGQRSVKVAKV

SEQ ID NO: 487 - protein, 20 aa, Artificial Sequence
  GFR-binding peptide
  MOD_RES (5)..(5): Xaa is C or S
RNVQXRPTQVQLRSVKVAKV

SEQ ID NO: 488 - protein, 20 aa, Artificial Sequence
  GFR-binding peptide
  MOD_RES (5)..(5): Xaa is C or S
SSVKXQPTQVHHRPVQVRKI

SEQ ID NO: 489 - protein, 20 aa, Artificial Sequence
  GFR-binding peptide
  MOD_RES (6)..(7): Xaa is C or S
KIPKAXXVPTELRPVQVRKI

SEQ ID NO: 490 - protein, 20 aa, Artificial Sequence
  GFR-binding peptide
  MOD_RES (6)..(7): Xaa is C or S
GIPEPXXVPEKMRPVQVRKI

SEQ ID NO: 491 - protein, 20 aa, Artificial Sequence
  GFR-binding peptide
  MOD_RES (6)..(7): Xaa is C or S
SIPKAXXVPTELRPVQVRKI

SEQ ID NO: 492 - protein, 20 aa, Artificial Sequence
  GFR-binding peptide
  MOD_RES (7)..(7): Xaa is C or S
HVTKPTXAPTKLRPVQVRKI

SEQ ID NO: 493 - protein, 20 aa, Artificial Sequence
  GFR-binding peptide
  MOD_RES (6)..(7): Xaa is C or S
YVPKPXXAPTKLRPVQVRKI

SEQ ID NO: 494 - protein, 20 aa, Artificial Sequence
  GFR-binding peptide
  MOD_RES (6)..(7): Xaa is C or S
TVPKPXXAPTQLRPVQVRKI

SEQ ID NO: 495 - protein, 20 aa, Artificial Sequence
  GFR-binding peptide
  MOD_RES (6)..(7): Xaa is C or S
AVPKAXXAPTKLRPVQVRKI

SEQ ID NO: 496 - protein, 20 aa, Artificial Sequence
  GFR-binding peptide
  MOD_RES (6)..(7): Xaa is C or S
KVGKAXXVPTKLRPVQVRKI

SEQ ID NO: 497 - protein, 20 aa, Artificial Sequence
  GFR-binding peptide
  MOD_RES (6)..(7): Xaa is C or S
KASKAXXVPTKLRPVQVRKI

SEQ ID NO: 498 - protein, 20 aa, Artificial Sequence
  GFR-binding peptide
  MOD_RES (6)..(7): Xaa is C or S
GSAGPXXTPTKMRPVQVRKI

SEQ ID NO: 499 - protein, 20 aa, Artificial Sequence
  GFR-binding peptide
  MOD_RES (6)..(7): Xaa is C or S
AAPASXXVPARLRPVQVRKI

SEQ ID NO: 500 - protein, 20 aa, Artificial Sequence
  GFR-binding peptide
  MOD_RES (6)..(7): Xaa is C or S
STPPTXXVPTRLRPVQVRKI

SEQ ID NO: 501 - protein, 20 aa, Artificial Sequence
  GFR-binding peptide
  MOD_RES (6)..(7): Xaa is C or S
HVPKPXXAPTKLRPVQVRKI

SEQ ID NO: 502 - protein, 20 aa, Artificial Sequence
  GFR-binding peptide
  MOD_RES (6)..(7): Xaa is C or S
RVPSTXXAPVKTRPVQVRKI

SEQ ID NO: 503 - protein, 20 aa, Artificial Sequence
  GFR-binding peptide
  MOD_RES (6)..(7): Xaa is C or S
ASASPXXVSQDLRPVQVRKI

SEQ ID NO: 504 - protein, 20 aa, Artificial Sequence
  GFR-binding peptide
  MOD_RES (7)..(7): Xaa is C or S
NDEGLEXVPTGQRPVQVRKI

SEQ ID NO: 505 - protein, 20 aa, Artificial Sequence
  GFR-binding peptide
  MOD_RES (5)..(5): Xaa is C or S
SSVKXQPSRVHHRPVQVRKI

SEQ ID NO: 506 - protein, 8 aa, Artificial Sequence
  GFR-binding peptide
SAISILYL

SEQ ID NO: 507 - protein, 8 aa, Artificial Sequence
  GFR-binding peptide
SAISVLYL

SEQ ID NO: 508 - protein, 8 aa, Artificial Sequence
  GFR-binding peptide
SSLSMLFF

SEQ ID NO: 509 - protein, 8 aa, Artificial Sequence
  GFR-binding peptide
SSLSVLFF

SEQ ID NO: 510 - protein, 8 aa, Artificial Sequence
  GFR-binding peptide
NAISMLYF

SEQ ID NO: 511 - protein, 8 aa, Artificial Sequence
  GFR-binding peptide
NAISILYF

SEQ ID NO: 512 - protein, 8 aa, Artificial Sequence
  GFR-binding peptide
SATSMLYY

SEQ ID NO: 513 - protein, 8 aa, Artificial Sequence
  GFR-binding peptide
SATSILYY

SEQ ID NO: 514 - protein, 8 aa, Artificial Sequence
  GFR-binding peptide
SPISMLYK

SEQ ID NO: 515 - protein, 8 aa, Artificial Sequence
  GFR-binding peptide
SPISILYK

SEQ ID NO: 516 - protein, 8 aa, Artificial Sequence
  GFR-binding peptide
EPISMLYL

SEQ ID NO: 517 - protein, 8 aa, Artificial Sequence
  GFR-binding peptide
EPISVLYL

SEQ ID NO: 518 - protein, 8 aa, Artificial Sequence
  GFR-binding peptide
SPINILYF

SEQ ID NO: 519 - protein, 8 aa, Artificial Sequence
  GFR-binding peptide
SPINVLYF

SEQ ID NO: 520 - protein, 8 aa, Artificial Sequence
  GFR-binding peptide
SPISMLYI

SEQ ID NO: 521 - protein, 8 aa, Artificial Sequence
  GFR-binding peptide
SPISVLYI

SEQ ID NO: 522 - protein, 8 aa, Artificial Sequence
  GFR-binding peptide
SPISMLFI

SEQ ID NO: 523 - protein, 8 aa, Artificial Sequence
  GFR-binding peptide
SPISVLFI

SEQ ID NO: 524 - protein, 8 aa, Artificial Sequence
  GFR-binding peptide
KPLSILYV

SEQ ID NO: 525 - protein, 8 aa, Artificial Sequence
  GFR-binding peptide
KPLSVLYV

SEQ ID NO: 526 - protein, 8 aa, Artificial Sequence
  GFR-binding peptide
EPLPMVYY

SEQ ID NO: 527 - protein, 8 aa, Artificial Sequence
  GFR-binding peptide
EPLPVVYY

SEQ ID NO: 528 - protein, 8 aa, Artificial Sequence
  GFR-binding peptide
EPLTMLYY

SEQ ID NO: 529 - protein, 8 aa, Artificial Sequence
  GFR-binding peptide
EPLTVLYY

SEQ ID NO: 530 - protein, 8 aa, Artificial Sequence
  GFR-binding peptide
SNITIQIM

SEQ ID NO: 531 - protein, 8 aa, Artificial Sequence
  GFR-binding peptide
SNITVQIM

SEQ ID NO: 532 - protein, 8 aa, Artificial Sequence
  GFR-binding peptide
RSVKMAKV

SEQ ID NO: 533 - protein, 8 aa, Artificial Sequence
  GFR-binding peptide
RSVKIAKV

SEQ ID NO: 534 - protein, 8 aa, Artificial Sequence
  GFR-binding peptide
RPVQMRKI

SEQ ID NO: 535 - protein, 8 aa, Artificial Sequence
  GFR-binding peptide
RPVQIRKI

SEQ ID NO: 536 - protein, 20 aa, Artificial Sequence
  GFR-binding peptide
  MOD_RES (14)..(15): Xaa is C or S
LYLMSIASMKTPVXXPGASG

SEQ ID NO: 537 - protein, 20 aa, Artificial Sequence
  GFR-binding peptide
  MOD_RES (14)..(15): Xaa is C or S
LYLMSIASLRTPVXXSAPAA

SEQ ID NO: 538 - protein, 20 aa, Artificial Sequence
  GFR-binding peptide
  MOD_RES (14)..(15): Xaa is C or S
LYLMSIASLRTPVXXTPPTS

SEQ ID NO: 539 - protein, 20 aa, Artificial Sequence
  GFR-binding peptide
  MOD_RES (14)..(14): Xaa is C or S
FYLVSIANEETPAXELGEDN

SEQ ID NO: 540 - protein, 20 aa, Artificial Sequence
  GFR-binding peptide
  MOD_RES (14)..(14): Xaa is C or S
FYLVSIANQGTPAXELGEDN

SEQ ID NO: 541 - protein, 20 aa, Artificial Sequence
  GFR-binding peptide
  MOD_RES (14)..(15): Xaa is C or S
YYLVSTASLETPVXXAKPIK

SEQ ID NO: 542 - protein, 20 aa, Artificial Sequence
  GFR-binding peptide
  MOD_RES (14)..(15): Xaa is C or S
YYLVSTASMKEPVXXPEPIG

SEQ ID NO: 543 - protein, 20 aa, Artificial Sequence
  GFR-binding peptide
  MOD_RES (14)..(15): Xaa is C or S
KYLVSIPSMKTPVXXPGASG

SEQ ID NO: 544 - protein, 20 aa, Artificial Sequence
  GFR-binding peptide
  MOD_RES (14)..(14): Xaa is C or S
FFLISLSSLKEPVXTPKTVH

SEQ ID NO: 545 - protein, 20 aa, Artificial Sequence
  GFR-binding peptide
  MOD_RES (14)..(15): Xaa is C or S
YYLITLPELKQSVXXAKGVK

SEQ ID NO: 546 - protein, 20 aa, Artificial Sequence
  GFR-binding peptide
  MOD_RES (16)..(16): Xaa is C or S
FYLVSIANLQVQTPRXQVNR

SEQ ID NO: 547 - protein, 20 aa, Artificial Sequence
  GFR-binding peptide
  MOD_RES (14)..(15): Xaa is C or S
LYLMSIASLKTPAXXPKPVH

SEQ ID NO: 548 - protein, 20 aa, Artificial Sequence
  GFR-binding peptide
  MOD_RES (14)..(15): Xaa is C or S
YYLITLPELKTPVXXAKGVK

SEQ ID NO: 549 - protein, 20 aa, Artificial Sequence
  GFR-binding peptide
  MOD_RES (16)..(16): Xaa is C or S
LYLMSIASLQVQTPRXQVNR

SEQ ID NO: 550 - protein, 20 aa, Artificial Sequence
  GFR-binding peptide
  MOD_RES (14)..(15): Xaa is C or S
LYLMSIASLDQSVXXPSASA

SEQ ID NO: 551 - protein, 20 aa, Artificial Sequence
  GFR-binding peptide
  MOD_RES (14)..(15): Xaa is C or S
KYLVSIPSLKTPVXXPKPVH

SEQ ID NO: 552 - protein, 20 aa, Artificial Sequence
  GFR-binding peptide
  MOD_RES (14)..(14): Xaa is C or S
FYLVSIANQGTPVXELGEDN

SEQ ID NO: 553 - protein, 20 aa, Artificial Sequence
  GFR-binding peptide
  MOD_RES (14)..(15): Xaa is C or S
LYLMSIASLQTPAXXPKPVT

SEQ ID NO: 554 - protein, 20 aa, Artificial Sequence
  GFR-binding peptide
  MOD_RES (14)..(15): Xaa is C or S
LYLMSIASLKTPAXXAKPVA

SEQ ID NO: 555 - protein, 20 aa, Artificial Sequence
  GFR-binding peptide
  MOD_RES (14)..(15): Xaa is C or S
LYLMSIASLKTPVXXAKGVK

SEQ ID NO: 556 - protein, 20 aa, Artificial Sequence
  GFR-binding peptide
  MOD_RES (14)..(15): Xaa is C or S
LYLMSIASLKTPVXXAKGGG

SEQ ID NO: 557 - protein, 24 aa, Artificial Sequence
  GFR-binding peptide
  MOD_RES (14)..(15): Xaa is C or S
LYLMSIASMKTPTXXPGASGWFWW

SEQ ID NO: 558 - protein, 25 aa, Artificial Sequence
  GFR-binding peptide
  MOD_RES (14)..(14): Xaa is C or S
LYLMSIASLKTPVXTPKTVHPGPTG

SEQ ID NO: 559 - protein, 18 aa, Artificial Sequence
  GFR-binding peptide
YYLITLPELEQPVPGPTG

SEQ ID NO: 560 - protein, 18 aa, Artificial Sequence
  GFR-binding peptide
KYLVSIPSLETPVPGPTG

SEQ ID NO: 561 - protein, 21 aa, Artificial Sequence
  GFR-binding peptide
  MOD_RES (14)..(15): Xaa is C or S
LYLMSIASLKTPVXXAPGPTG

SEQ ID NO: 562 - protein, 18 aa, Artificial Sequence
  GFR-binding peptide
LYLMSIASQGTPVPGPTG

SEQ ID NO: 563 - protein, 18 aa, Artificial Sequence
  GFR-binding peptide
LYLMSIASEETPVPGPTG

SEQ ID NO: 564 - protein, 21 aa, Artificial Sequence
  GFR-binding peptide
KYLVSIPSLKTPVSTPPGPTG

SEQ ID NO: 565 - protein, 21 aa, Artificial Sequence
  GFR-binding peptide
  MOD_RES (14)..(15): Xaa is C or S
KYLVSIPSLKTPVXXPPGPTG

SEQ ID NO: 566 - protein, 25 aa, Artificial Sequence
  GFR-binding peptide
  MOD_RES (14)..(14): Xaa is C or S
FYLVSIANQGTPAXELGEDNPGPTG

SEQ ID NO: 567 - protein, 25 aa, Artificial Sequence
  GFR-binding peptide
  MOD_RES (14)..(15): Xaa is C or S
KYLVSIPSLRTPVXXSAPAAGWFWW

SEQ ID NO: 568 - protein, 25 aa, Artificial Sequence
  GFR-binding peptide
  MOD_RES (14)..(15): Xaa is C or S
LYLMSIASLKTPVXXAKSAKGWFWW

SEQ ID NO: 569 - protein, 25 aa, Artificial Sequence
  GFR-binding peptide
  MOD_RES (14)..(15): Xaa is C or S
LYLMSIASMKTPTXXPGASGPGPTG

SEQ ID NO: 570 - protein, 25 aa, Artificial Sequence
  GFR-binding peptide
  MOD_RES (14)..(15): Xaa is C or S
LYLMSIASLRAPVXXSAPAAPGPTG

SEQ ID NO: 571 - protein, 20 aa, Artificial Sequence
  GFR-binding peptide
  MOD_RES (14)..(15): Xaa is C or S
YYVIPLPELKTPAXXAKPVA

SEQ ID NO: 572 - protein, 20 aa, Artificial Sequence
  GFR-binding peptide
  MOD_RES (14)..(15): Xaa is C or S
YYLITLPELEQSVXXAKPIK

SEQ ID NO: 573 - protein, 20 aa, Artificial Sequence
  GFR-binding peptide
  MOD_RES (14)..(15): Xaa is C or S
VKAVKVSRLRVRSXXTPPTS

SEQ ID NO: 574 - protein, 20 aa, Artificial Sequence
  GFR-binding peptide
  MOD_RES (14)..(15): Xaa is C or S
MIQMTINSLKTPVXXAKGVK

SEQ ID NO: 575 - protein, 20 aa, Artificial Sequence
  GFR-binding peptide
  MOD_RES (14)..(15): Xaa is C or S
IKRVQVPRLDVQTXXPSASA

SEQ ID NO: 576 - protein, 20 aa, Artificial Sequence
  GFR-binding peptide
  MOD_RES (14)..(15): Xaa is C or S
FFLISLSSLKEPVXXAKSAA

SEQ ID NO: 577 - protein, 20 aa, Artificial Sequence
  GFR-binding peptide
  MOD_RES (14)..(15): Xaa is C or S
FFLISLSSMKEPVXXPGASG

SEQ ID NO: 578 - protein, 20 aa, Artificial Sequence
  GFR-binding peptide
  MOD_RES (14)..(15): Xaa is C or S
IYLISIPSTKAPVXXTSPVR

SEQ ID NO: 579 - protein, 20 aa, Artificial Sequence
  GFR-binding peptide
  MOD_RES (14)..(15): Xaa is C or S
IYLISIPSLAAPVXXPAASA

SEQ ID NO: 580 - protein, 20 aa, Artificial Sequence
  GFR-binding peptide
  MOD_RES (14)..(14): Xaa is C or S
IYLISIPSEEAPVXELGEDN

SEQ ID NO: 581 - protein, 13 aa, Artificial Sequence
  GFR-binding peptide
IYLISIPSQGAPV

SEQ ID NO: 582 - protein, 20 aa, Artificial Sequence
  GFR-binding peptide
  MOD_RES (14)..(14): Xaa is C or S
IYLISIPSEEAPVXELGEDN

SEQ ID NO: 583 - protein, 13 aa, Artificial Sequence
  GFR-binding peptide
IYLISIPSEEAPV

SEQ ID NO: 584 - protein, 20 aa, Artificial Sequence
  GFR-binding peptide
  MOD_RES (14)..(15): Xaa is C or S
IYLISIPSMKAPVXXPEPIG

SEQ ID NO: 585 - protein, 20 aa, Artificial Sequence
  GFR-binding peptide
  MOD_RES (14)..(15): Xaa is C or S
IKRVQVPRLAQPVXXPAASA

SEQ ID NO: 586 - protein, 18 aa, Artificial Sequence
  GFR-binding peptide
  MOD_RES (14)..(15): Xaa is C or S
IKRVQVPRLDQSVXXPSA

SEQ ID NO: 587 - protein, 20 aa, Artificial Sequence
  GFR-binding peptide
  MOD_RES (14)..(15): Xaa is C or S
IKRVQVPRLDQPVXXPSASA

SEQ ID NO: 588 - protein, 20 aa, Artificial Sequence
  GFR-binding peptide
  MOD_RES (14)..(14): Xaa is C or S
IKRVQVPREETPVXELGEDN

SEQ ID NO: 589 - protein, 8 aa, Artificial Sequence
  GFR-binding peptide
IKRVQVPR

SEQ ID NO: 590 - protein, 20 aa, Artificial Sequence
  GFR-binding peptide
  MOD_RES (14)..(15): Xaa is C or S
MIQMTINSLQTPVXXPKPVT

SEQ ID NO: 591 - protein, 20 aa, Artificial Sequence
  GFR-binding peptide
  MOD_RES (14)..(15): Xaa is C or S
MIQMTINSLKTPVXXAKPVA

SEQ ID NO: 592 - protein, 20 aa, Artificial Sequence
  GFR-binding peptide
  MOD_RES (14)..(15): Xaa is C or S
FYLMNIPSLETPTXXAKPIS

SEQ ID NO: 593 - protein, 18 aa, Artificial Sequence
  GFR-binding peptide
FYLMNIPSLKTPTSTPKT

SEQ ID NO: 594 - protein, 20 aa, Artificial Sequence
  GFR-binding peptide
  MOD_RES (14)..(15): Xaa is C or S
FYLMNIPSLKTPTXXPKPVY

SEQ ID NO: 595 - protein, 20 aa, Artificial Sequence
  GFR-binding peptide
  MOD_RES (14)..(15): Xaa is C or S
FFLISLSSLAQPVXXPAASA

SEQ ID NO: 596 - protein, 20 aa, Artificial Sequence
  GFR-binding peptide
  MOD_RES (14)..(15): Xaa is C or S
FFLISLSSLDQSVXXPSASA

SEQ ID NO: 597 - protein, 20 aa, Artificial Sequence
  GFR-binding peptide
  MOD_RES (14)..(15): Xaa is C or S
LYLISIPELQTPAXXPKPVV

SEQ ID NO: 598 - protein, 20 aa, Artificial Sequence
  GFR-binding peptide
  MOD_RES (14)..(15): Xaa is C or S
LYLISIPELKTPAXXAKPVA

SEQ ID NO: 599 - protein, 20 aa, Artificial Sequence
  GFR-binding peptide
  MOD_RES (14)..(15): Xaa is C or S
LYLISIPELKTPVXXAKGVK

SEQ ID NO: 600 - protein, 20 aa, Artificial Sequence
  GFR-binding peptide
  MOD_RES (16)..(16): Xaa is C or S
VYLMSLPKHHVRSPQXKVSS

SEQ ID NO: 601 - protein, 20 aa, Artificial Sequence
  GFR-binding peptide
  MOD_RES (16)..(16): Xaa is C or S
VYLMSLPKLQVQTPRXQVNR

SEQ ID NO: 602 - protein, 20 aa, Artificial Sequence
  GFR-binding peptide
  MOD_RES (14)..(15): Xaa is C or S
YYVIPLPELEQPVXXAKPIK

SEQ ID NO: 603 - protein, 20 aa, Artificial Sequence
  GFR-binding peptide
  MOD_RES (14)..(15): Xaa is C or S
YYVIPLPEMKQPVXXPEPIG

SEQ ID NO: 604 - protein, 20 aa, Artificial Sequence
  GFR-binding peptide
  MOD_RES (14)..(15): Xaa is C or S
YYVIPLPELEQPVXXAKPIS

SEQ ID NO: 605 - protein, 20 aa, Artificial Sequence
  GFR-binding peptide
  MOD_RES (14)..(15): Xaa is C or S
YYLITLPELAQPVXXPAASA

SEQ ID NO: 606 - protein, 20 aa, Artificial Sequence
  GFR-binding peptide
  MOD_RES (14)..(15): Xaa is C or S
YYLITLPELDQSVXXPSASA

SEQ ID NO: 607 - protein, 20 aa, Artificial Sequence
  GFR-binding peptide
  MOD_RES (14)..(14): Xaa is C or S
YYLITLPEEETPVXELGEDN

SEQ ID NO: 608 - protein, 20 aa, Artificial Sequence
  GFR-binding peptide
  MOD_RES (14)..(14): Xaa is C or S
FFLISLSSEETPVXELGEDN

SEQ ID NO: 609 - protein, 20 aa, Artificial Sequence
  GFR-binding peptide
  MOD_RES (14)..(15): Xaa is C or S
MIQMTINSLKTPVXXAKSAK

SEQ ID NO: 610 - protein, 20 aa, Artificial Sequence
  GFR-binding peptide
  MOD_RES (14)..(15): Xaa is C or S
MIQMTINSMKTPTXXPGASG

SEQ ID NO: 611 - protein, 20 aa, Artificial Sequence
  GFR-binding peptide
  MOD_RES (14)..(15): Xaa is C or S
MIQMTINSLRAPVXXSAPAA

SEQ ID NO: 612 - protein, 20 aa, Artificial Sequence
  GFR-binding peptide
  MOD_RES (14)..(15): Xaa is C or S
YYLVSTASTKTPAXXTSPVR

SEQ ID NO: 613 - protein, 20 aa, Artificial Sequence
  GFR-binding peptide
  MOD_RES (14)..(15): Xaa is C or S
YYLVSTASLATPAXXPAASA

SEQ ID NO: 614 - protein, 20 aa, Artificial Sequence
  GFR-binding peptide
  MOD_RES (14)..(15): Xaa is C or S
YYLVSTASLDTPAXXPSASA

SEQ ID NO: 615 - protein, 20 aa, Artificial Sequence
  GFR-binding peptide
  MOD_RES (14)..(15): Xaa is C or S
VKAVKVSRLETPVXXAKPIS

SEQ ID NO: 616 - protein, 20 aa, Artificial Sequence
  GFR-binding peptide
  MOD_RES (14)..(14): Xaa is C or S
VKAVKVSRLKTPAXTPKTVH

SEQ ID NO: 617 - protein, 20 aa, Artificial Sequence
  GFR-binding peptide
  MOD_RES (14)..(15): Xaa is C or S
VKAVKVSRLQTPAXXPKPVT

SEQ ID NO: 618 - protein, 20 aa, Artificial Sequence
  GFR-binding peptide
  MOD_RES (14)..(15): Xaa is C or S
YYVIPLPELKQPVXXAKGVK

SEQ ID NO: 619 - protein, 20 aa, Artificial Sequence
  GFR-binding peptide
  MOD_RES (14)..(15): Xaa is C or S
YYVIPLPELKQPVXXAKSAK

SEQ ID NO: 620 - protein, 20 aa, Artificial Sequence
  GFR-binding peptide
  MOD_RES (16)..(16): Xaa is C or S
KYLVSIPSLQTPVPRXQVNR

SEQ ID NO: 621 - protein, 20 aa, Artificial Sequence
  GFR-binding peptide
  MOD_RES (14)..(15): Xaa is C or S
KYLVSIPSLETPVXXAKPIK

SEQ ID NO: 622 - protein, 20 aa, Artificial Sequence
  GFR-binding peptide
  MOD_RES (14)..(15): Xaa is C or S
VKAVKVSRLAQPVXXPAASA

SEQ ID NO: 623 - protein, 13 aa, Artificial Sequence
  GFR-binding peptide
VKAVKVSRLDQSV

SEQ ID NO: 624 - protein, 20 aa, Artificial Sequence
  GFR-binding peptide
  MOD_RES (14)..(15): Xaa is C or S
VKAVKVSRLDQPVXXPSASA

SEQ ID NO: 625 - protein, 20 aa, Artificial Sequence
  GFR-binding peptide
  MOD_RES (14)..(14): Xaa is C or S
VKAVKVSREETPVXELGEDN

SEQ ID NO: 626 - protein, 13 aa, Artificial Sequence
  GFR-binding peptide
IKRVQVPRMKVQT

SEQ ID NO: 627 - protein, 20 aa, Artificial Sequence
  GFR-binding peptide
  MOD_RES (14)..(15): Xaa is C or S
IKRVQVPRLEVQTXXAKPIS

SEQ ID NO: 628 - protein, 20 aa, Artificial Sequence
  GFR-binding peptide
  MOD_RES (14)..(15): Xaa is C or S
FYLMNIPSLETPTXXAKPIK

SEQ ID NO: 629 - protein, 20 aa, Artificial Sequence
  GFR-binding peptide
  MOD_RES (14)..(15): Xaa is C or S
FYLMNIPSMKTPTXXPEPIG

SEQ ID NO: 630 - protein, 13 aa, Artificial Sequence
  GFR-binding peptide
LYLMSIASQGTPV

SEQ ID NO: 631 - protein, 20 aa, Artificial Sequence
  GFR-binding peptide
  MOD_RES (14)..(14): Xaa is C or S
LYLMSIASEETPVXELGEDN

SEQ ID NO: 632 - protein, 20 aa, Artificial Sequence
  GFR-binding peptide
  MOD_RES (14)..(14): Xaa is C or S
IYLISIPSEETPVXELGEDN

SEQ ID NO: 633 - protein, 20 aa, Artificial Sequence
  GFR-binding peptide
  MOD_RES (16)..(16): Xaa is C or S
IYLISIPSHHVRSPQXKVVV

SEQ ID NO: 634 - protein, 20 aa, Artificial Sequence
  GFR-binding peptide
  MOD_RES (16)..(16): Xaa is C or S
IFLISIPSHHVRSPQXKVSS

SEQ ID NO: 635 - protein, 20 aa, Artificial Sequence
  GFR-binding peptide
  MOD_RES (16)..(16): Xaa is C or S
IFLISIPSLQVQTPRXQVNR

SEQ ID NO: 636 - protein, 20 aa, Artificial Sequence
  GFR-binding peptide
  MOD_RES (14)..(15): Xaa is C or S
FYLVSIANLKTPAXXPKPVY

SEQ ID NO: 637 - protein, 20 aa, Artificial Sequence
  GFR-binding peptide
  MOD_RES (14)..(15): Xaa is C or S
LYLMSIASTKTPVXXTSPVR

SEQ ID NO: 638 - protein, 20 aa, Artificial Sequence
  GFR-binding peptide
  MOD_RES (14)..(15): Xaa is C or S
LYLISIPELKTPAXXPKPVH

SEQ ID NO: 639 - protein, 20 aa, Artificial Sequence
  GFR-binding peptide
  MOD_RES (14)..(15): Xaa is C or S
LYLISIPETKVPAXXTSPVR

SEQ ID NO: 640 - protein, 20 aa, Artificial Sequence
  GFR-binding peptide
  MOD_RES (14)..(15): Xaa is C or S
LYLMSIASMKTPVXXPEPIG

SEQ ID NO: 641 - protein, 20 aa, Artificial Sequence
  GFR-binding peptide
  MOD_RES (14)..(14): Xaa is C or S
LYLMSIASLKTPVXTPKTVH

SEQ ID NO: 642 - protein, 20 aa, Artificial Sequence
  GFR-binding peptide
  MOD_RES (14)..(15): Xaa is C or S
LYLMSIASLKTPVXXPKPVY

SEQ ID NO: 643 - protein, 20 aa, Artificial Sequence
  GFR-binding peptide
  MOD_RES (14)..(15): Xaa is C or S
LYLMSIASLQTPVXXPKPVT

SEQ ID NO: 644 - protein, 20 aa, Artificial Sequence
  GFR-binding peptide
  MOD_RES (14)..(15): Xaa is C or S
LYLMSIASLKTPVXXAKPVA

SEQ ID NO: 645 - protein, 20 aa, Artificial Sequence
  GFR-binding peptide
  MOD_RES (14)..(15): Xaa is C or S
LYLMSIASLKTPVXXAKSAK

SEQ ID NO: 646 - protein, 20 aa, Artificial Sequence
  GFR-binding peptide
  MOD_RES (14)..(15): Xaa is C or S
LYLMSIASLKTPVXXPKPVH

SEQ ID NO: 647 - protein, 20 aa, Artificial Sequence
  GFR-binding peptide
  MOD_RES (14)..(15): Xaa is C or S
LYLMSIASLATPVXXPAASA

SEQ ID NO: 648 - protein, 20 aa, Artificial Sequence
  GFR-binding peptide
  MOD_RES (14)..(15): Xaa is C or S
LYLMSIASLDTPVXXPSASA

SEQ ID NO: 649 - protein, 20 aa, Artificial Sequence
  GFR-binding peptide
  MOD_RES (14)..(15): Xaa is C or S
LYLMSIASLDTPVXXPSASA

SEQ ID NO: 650 - protein, 20 aa, Artificial Sequence
  GFR-binding peptide
  MOD_RES (14)..(15): Xaa is C or S
LYLMSIASMKEPVXXPEPIG

SEQ ID NO: 651 - protein, 20 aa, Artificial Sequence
  GFR-binding peptide
  MOD_RES (14)..(14): Xaa is C or S
LYLMSIASLKTPAXTPKTVH

SEQ ID NO: 652 - protein, 20 aa, Artificial Sequence
  GFR-binding peptide
  MOD_RES (14)..(15): Xaa is C or S
LYLMSIASLKTPAXXPKPVY

SEQ ID NO: 653 - protein, 20 aa, Artificial Sequence
  GFR-binding peptide
  MOD_RES (14)..(15): Xaa is C or S
LYLMSIASMKTPTXXPGASG

SEQ ID NO: 654 - protein, 20 aa, Artificial Sequence
  GFR-binding peptide
  MOD_RES (14)..(15): Xaa is C or S
LYLMSIASLRAPVXXSAPAA

SEQ ID NO: 655 - protein, 20 aa, Artificial Sequence
  GFR-binding peptide
  MOD_RES (14)..(15): Xaa is C or S
LYLMSIASTKVPAXXTSPVR

SEQ ID NO: 656 - protein, 20 aa, Artificial Sequence
  GFR-binding peptide
  MOD_RES (14)..(15): Xaa is C or S
LYLMSIASLAQPVXXPAASA

SEQ ID NO: 657 - protein, 20 aa, Artificial Sequence
  GFR-binding peptide
  MOD_RES (14)..(15): Xaa is C or S
LYLMSIASLDQPVXXPSASA

SEQ ID NO: 658 - protein, 20 aa, Artificial Sequence
  GFR-binding peptide
  MOD_RES (16)..(16): Xaa is C or S
LYLMSIASHHVRSPQXKVSS

SEQ ID NO: 659 - protein, 20 aa, Artificial Sequence
  GFR-binding peptide
  MOD_RES (14)..(15): Xaa is C or S
FFLISLSSLEEPVXXAKPIK

SEQ ID NO: 660 - protein, 20 aa, Artificial Sequence
  GFR-binding peptide
  MOD_RES (14)..(15): Xaa is C or S
FFLISLSSLEEPVXXAKPIS

SEQ ID NO: 661 - protein, 20 aa, Artificial Sequence
  GFR-binding peptide
  MOD_RES (14)..(15): Xaa is C or S
FFLISLSSLKEPVXXPKPVY

SEQ ID NO: 662 - protein, 20 aa, Artificial Sequence
  GFR-binding peptide
  MOD_RES (14)..(15): Xaa is C or S
FFLISLSSLQEPVXXPKPVT

SEQ ID NO: 663 - protein, 20 aa, Artificial Sequence
  GFR-binding peptide
  MOD_RES (14)..(15): Xaa is C or S
FFLISLSSLKEPVXXAKPVA

SEQ ID NO: 664 - protein, 20 aa, Artificial Sequence
  GFR-binding peptide
  MOD_RES (14)..(15): Xaa is C or S
FFLISLSSLKEPVXXAKGVK

SEQ ID NO: 665 - protein, 20 aa, Artificial Sequence
  GFR-binding peptide
  MOD_RES (14)..(15): Xaa is C or S
FFLISLSSLKEPVXXAKSAK

SEQ ID NO: 666 - protein, 20 aa, Artificial Sequence
  GFR-binding peptide
  MOD_RES (14)..(15): Xaa is C or S
FFLISLSSLREPVXXSAPAA

SEQ ID NO: 667 - protein, 20 aa, Artificial Sequence
  GFR-binding peptide
  MOD_RES (14)..(15): Xaa is C or S
FFLISLSSLREPVXXTPPTS

SEQ ID NO: 668 - protein, 20 aa, Artificial Sequence
  GFR-binding peptide
  MOD_RES (14)..(15): Xaa is C or S
FFLISLSSLKEPVXXPKPVH

SEQ ID NO: 669 - protein, 20 aa, Artificial Sequence
  GFR-binding peptide
  MOD_RES (14)..(15): Xaa is C or S
FFLISLSSTKEPVXXTSPVR

SEQ ID NO: 670 - protein, 20 aa, Artificial Sequence
  GFR-binding peptide
  MOD_RES (14)..(15): Xaa is C or S
FFLISLSSLAEPVXXPAASA

SEQ ID NO: 671 - protein, 20 aa, Artificial Sequence
  GFR-binding peptide
  MOD_RES (14)..(15): Xaa is C or S
FFLISLSSLDEPVXXPSASA

SEQ ID NO: 672 - protein, 20 aa, Artificial Sequence
  GFR-binding peptide
  MOD_RES (14)..(15): Xaa is C or S
FFLISLSSLDEPVXXPSASA

SEQ ID NO: 673 - protein, 20 aa, Artificial Sequence
  GFR-binding peptide
  MOD_RES (14)..(15): Xaa is C or S
FFLISLSSLETPVXXAKPIK

SEQ ID NO: 674 - protein, 20 aa, Artificial Sequence
  GFR-binding peptide
  MOD_RES (14)..(15): Xaa is C or S
FFLISLSSLETPVXXAKPIS

SEQ ID NO: 675 - protein, 20 aa, Artificial Sequence
  GFR-binding peptide
  MOD_RES (14)..(14): Xaa is C or S
FFLISLSSLKTPAXTPKTVH

SEQ ID NO: 676 - protein, 20 aa, Artificial Sequence
  GFR-binding peptide
  MOD_RES (14)..(15): Xaa is C or S
FFLISLSSLKTPAXXPKPVY

SEQ ID NO: 677 - protein, 20 aa, Artificial Sequence
  GFR-binding peptide
  MOD_RES (14)..(15): Xaa is C or S
FFLISLSSLQTPAXXPKPVT

SEQ ID NO: 678 - protein, 20 aa, Artificial Sequence
  GFR-binding peptide
  MOD_RES (14)..(15): Xaa is C or S
FFLISLSSLKTPAXXAKPVA

SEQ ID NO: 679 - protein, 20 aa, Artificial Sequence
  GFR-binding peptide
  MOD_RES (14)..(15): Xaa is C or S
FFLISLSSLKTPVXXAKGVK

SEQ ID NO: 680 - protein, 20 aa, Artificial Sequence
  GFR-binding peptide
  MOD_RES (14)..(15): Xaa is C or S
FFLISLSSLKTPVXXAKSAK

SEQ ID NO: 681 - protein, 20 aa, Artificial Sequence
  GFR-binding peptide
  MOD_RES (14)..(15): Xaa is C or S
FFLISLSSMKTPTXXPGASG

SEQ ID NO: 682 - protein, 20 aa, Artificial Sequence
  GFR-binding peptide
  MOD_RES (14)..(15): Xaa is C or S
FFLISLSSLRAPVXXSAPAA

SEQ ID NO: 683 - protein, 20 aa, Artificial Sequence
  GFR-binding peptide
  MOD_RES (14)..(15): Xaa is C or S
FFLISLSSLRTPVXXTPPTS

SEQ ID NO: 684 - protein, 20 aa, Artificial Sequence
  GFR-binding peptide
  MOD_RES (14)..(15): Xaa is C or S
FFLISLSSLKTPAXXPKPVH

SEQ ID NO: 685 - protein, 20 aa, Artificial Sequence
  GFR-binding peptide
  MOD_RES (14)..(15): Xaa is C or S
FFLISLSSTKVPAXXTSPVR

SEQ ID NO: 686 - protein, 20 aa, Artificial Sequence
  GFR-binding peptide
  MOD_RES (14)..(15): Xaa is C or S
FFLISLSSLDQPVXXPSASA

SEQ ID NO: 687 - protein, 20 aa, Artificial Sequence
  GFR-binding peptide
  MOD_RES (14)..(14): Xaa is C or S
FFLISLSSQGTPVXELGEDN

SEQ ID NO: 688 - protein, 20 aa, Artificial Sequence
  GFR-binding peptide
  MOD_RES (16)..(16): Xaa is C or S
FFLISLSSHHVRSPQXKVSS

SEQ ID NO: 689 - protein, 20 aa, Artificial Sequence
  GFR-binding peptide
  MOD_RES (16)..(16): Xaa is C or S
FFLISLSSLQVQTPRXQVNR

SEQ ID NO: 690 - protein, 20 aa, Artificial Sequence
  GFR-binding peptide
  MOD_RES (14)..(15): Xaa is C or S
FYLVSIANLETPAXXAKPIK

SEQ ID NO: 691 - protein, 20 aa, Artificial Sequence
  GFR-binding peptide
  MOD_RES (14)..(15): Xaa is C or S
FYLVSIANMKTPAXXPEPIG

SEQ ID NO: 692 - protein, 20 aa, Artificial Sequence
  GFR-binding peptide
  MOD_RES (14)..(15): Xaa is C or S
FYLVSIANLETPAXXAKPIS

SEQ ID NO: 693 - protein, 20 aa, Artificial Sequence
  GFR-binding peptide
  MOD_RES (14)..(15): Xaa is C or S
FYLVSIANLKTPAXXAKPVA

SEQ ID NO: 694 - protein, 20 aa, Artificial Sequence
  GFR-binding peptide
  MOD_RES (14)..(15): Xaa is C or S
FYLVSIANLKTPAXXAKGVK

SEQ ID NO: 695 - protein, 20 aa, Artificial Sequence
  GFR-binding peptide
  MOD_RES (14)..(15): Xaa is C or S
FYLVSIANLKTPAXXAKSAK

SEQ ID NO: 696 - protein, 20 aa, Artificial Sequence
  GFR-binding peptide
  MOD_RES (14)..(15): Xaa is C or S
FYLVSIANMKTPAXXPGASG

SEQ ID NO: 697 - protein, 20 aa, Artificial Sequence
  GFR-binding peptide
  MOD_RES (14)..(15): Xaa is C or S
FYLVSIANLRTPAXXSAPAA

SEQ ID NO: 698 - protein, 20 aa, Artificial Sequence
  GFR-binding peptide
  MOD_RES (14)..(15): Xaa is C or S
FYLVSIANLRTPAXXTPPTS

SEQ ID NO: 699 - protein, 20 aa, Artificial Sequence
  GFR-binding peptide
  MOD_RES (14)..(15): Xaa is C or S
FYLVSIANTKTPAXXTSPVR

SEQ ID NO: 700 - protein, 20 aa, Artificial Sequence
  GFR-binding peptide
  MOD_RES (14)..(15): Xaa is C or S
FYLVSIANLATPAXXPAASA

SEQ ID NO: 701 - protein, 20 aa, Artificial Sequence
  GFR-binding peptide
  MOD_RES (14)..(15): Xaa is C or S
FYLVSIANLDTPAXXPSASA

SEQ ID NO: 702 - protein, 20 aa, Artificial Sequence
  GFR-binding peptide
  MOD_RES (14)..(15): Xaa is C or S
FYLVSIANLDTPAXXPSASA

SEQ ID NO: 703 - protein, 20 aa, Artificial Sequence
  GFR-binding peptide
  MOD_RES (14)..(15): Xaa is C or S
FYLVSIANLETPVXXAKPIK

SEQ ID NO: 704 - protein, 20 aa, Artificial Sequence
  GFR-binding peptide
  MOD_RES (14)..(15): Xaa is C or S
FYLVSIANMKEPVXXPEPIG

SEQ ID NO: 705 - protein, 20 aa, Artificial Sequence
  GFR-binding peptide
  MOD_RES (14)..(15): Xaa is C or S
FYLVSIANLETPVXXAKPIS

SEQ ID NO: 706 - protein, 20 aa, Artificial Sequence
  GFR-binding peptide
  MOD_RES (14)..(15): Xaa is C or S
FYLVSIANLKTPVXXAKGVK

SEQ ID NO: 707 - protein, 20 aa, Artificial Sequence
  GFR-binding peptide
  MOD_RES (14)..(15): Xaa is C or S
FYLVSIANLKTPVXXAKSAK

SEQ ID NO: 708 - protein, 20 aa, Artificial Sequence
  GFR-binding peptide
  MOD_RES (14)..(15): Xaa is C or S
FYLVSIANMKTPTXXPGASG

SEQ ID NO: 709 - protein, 20 aa, Artificial Sequence
  GFR-binding peptide
  MOD_RES (14)..(15): Xaa is C or S
FYLVSIANLRAPVXXSAPAA

SEQ ID NO: 710 - protein, 20 aa, Artificial Sequence
  GFR-binding peptide
  MOD_RES (14)..(15): Xaa is C or S
FYLVSIANLRTPVXXTPPTS

SEQ ID NO: 711 - protein, 20 aa, Artificial Sequence
  GFR-binding peptide
  MOD_RES (14)..(15): Xaa is C or S
FYLVSIANTKVPAXXTSPVR

SEQ ID NO: 712 - protein, 20 aa, Artificial Sequence
  GFR-binding peptide
  MOD_RES (14)..(15): Xaa is C or S
FYLVSIANLAQPVXXPAASA

SEQ ID NO: 713 - protein, 20 aa, Artificial Sequence
  GFR-binding peptide
  MOD_RES (14)..(15): Xaa is C or S
FYLVSIANLDQSVXXPSASA

SEQ ID NO: 714 - protein, 20 aa, Artificial Sequence
  GFR-binding peptide
  MOD_RES (14)..(15): Xaa is C or S
FYLVSIANLDQPVXXPSASA

SEQ ID NO: 715 - protein, 20 aa, Artificial Sequence
  GFR-binding peptide
  MOD_RES (14)..(14): Xaa is C or S
FYLVSIANEETPVXELGEDN

SEQ ID NO: 716 - protein, 20 aa, Artificial Sequence
  GFR-binding peptide
  MOD_RES (16)..(16): Xaa is C or S
FYLVSIANHHVRSPQXKVSS

SEQ ID NO: 717 - protein, 20 aa, Artificial Sequence
  GFR-binding peptide
  MOD_RES (14)..(15): Xaa is C or S
YYLVSTASLETPAXXAKPIK

SEQ ID NO: 718 - protein, 20 aa, Artificial Sequence
  GFR-binding peptide
  MOD_RES (14)..(15): Xaa is C or S
YYLVSTASMKTPAXXPEPIG

SEQ ID NO: 719 - protein, 20 aa, Artificial Sequence
  GFR-binding peptide
  MOD_RES (14)..(15): Xaa is C or S
YYLVSTASLETPAXXAKPIS

SEQ ID NO: 720 - protein, 20 aa, Artificial Sequence
  GFR-binding peptide
  MOD_RES (14)..(14): Xaa is C or S
YYLVSTASLKTPAXTPKTVH

SEQ ID NO: 721 - protein, 20 aa, Artificial Sequence
  GFR-binding peptide
  MOD_RES (14)..(15): Xaa is C or S
YYLVSTASLKTPAXXPKPVY

SEQ ID NO: 722 - protein, 20 aa, Artificial Sequence
  GFR-binding peptide
  MOD_RES (14)..(15): Xaa is C or S
YYLVSTASLQTPAXXPKPVT

SEQ ID NO: 723 - protein, 20 aa, Artificial Sequence
  GFR-binding peptide
  MOD_RES (14)..(15): Xaa is C or S
YYLVSTASLKTPAXXAKGVK

SEQ ID NO: 724 - protein, 20 aa, Artificial Sequence
  GFR-binding peptide
  MOD_RES (14)..(15): Xaa is C or S
YYLVSTASLKTPAXXAKSAK

SEQ ID NO: 725 - protein, 20 aa, Artificial Sequence
  GFR-binding peptide
  MOD_RES (14)..(15): Xaa is C or S
YYLVSTASMKTPAXXPGASG

SEQ ID NO: 726 - protein, 20 aa, Artificial Sequence
  GFR-binding peptide
  MOD_RES (14)..(15): Xaa is C or S
YYLVSTASLRTPAXXSAPAA

SEQ ID NO: 727 - protein, 20 aa, Artificial Sequence
  GFR-binding peptide
  MOD_RES (14)..(15): Xaa is C or S
YYLVSTASLRTPAXXTPPTS

SEQ ID NO: 728 - protein, 20 aa, Artificial Sequence
  GFR-binding peptide
  MOD_RES (14)..(15): Xaa is C or S
YYLVSTASLKTPAXXPKPVH

SEQ ID NO: 729 - protein, 20 aa, Artificial Sequence
  GFR-binding peptide
  MOD_RES (14)..(15): Xaa is C or S
YYLVSTASLETPVXXAKPIS

SEQ ID NO: 730 - protein, 20 aa, Artificial Sequence
  GFR-binding peptide
  MOD_RES (14)..(15): Xaa is C or S
YYLVSTASLKTPVXXAKGVK

SEQ ID NO: 731 - protein, 20 aa, Artificial Sequence
  GFR-binding peptide
  MOD_RES (14)..(15): Xaa is C or S
YYLVSTASLKTPVXXAKSAK

SEQ ID NO: 732 - protein, 20 aa, Artificial Sequence
  GFR-binding peptide
  MOD_RES (14)..(15): Xaa is C or S
YYLVSTASMKTPTXXPGASG

SEQ ID NO: 733 - protein, 20 aa, Artificial Sequence
  GFR-binding peptide
  MOD_RES (14)..(15): Xaa is C or S
YYLVSTASLRAPVXXSAPAA

SEQ ID NO: 734 - protein, 20 aa, Artificial Sequence
  GFR-binding peptide
  MOD_RES (14)..(15): Xaa is C or S
YYLVSTASLRTPVXXTPPTS

SEQ ID NO: 735 - protein, 20 aa, Artificial Sequence
  GFR-binding peptide
  MOD_RES (14)..(15): Xaa is C or S
YYLVSTASTKVPAXXTSPVR

SEQ ID NO: 736 - protein, 20 aa, Artificial Sequence
  GFR-binding peptide
  MOD_RES (14)..(15): Xaa is C or S
YYLVSTASLAQPVXXPAASA

SEQ ID NO: 737 - protein, 20 aa, Artificial Sequence
  GFR-binding peptide
  MOD_RES (14)..(15): Xaa is C or S
YYLVSTASLDQSVXXPSASA

SEQ ID NO: 738 - protein, 20 aa, Artificial Sequence
  GFR-binding peptide
  MOD_RES (14)..(15): Xaa is C or S
YYLVSTASLDQPVXXPSASA

SEQ ID NO: 739 - protein, 20 aa, Artificial Sequence
  GFR-binding peptide
  MOD_RES (14)..(14): Xaa is C or S
YYLVSTASEETPVXELGEDN

SEQ ID NO: 740 - protein, 20 aa, Artificial Sequence
  GFR-binding peptide
  MOD_RES (14)..(14): Xaa is C or S
YYLVSTASQGTPVXELGEDN

SEQ ID NO: 741 - protein, 20 aa, Artificial Sequence
  GFR-binding peptide
  MOD_RES (16)..(16): Xaa is C or S
YYLVSTASHHVRSPQXKVSS

SEQ ID NO: 742 - protein, 20 aa, Artificial Sequence
  GFR-binding peptide
  MOD_RES (16)..(16): Xaa is C or S
YYLVSTASLQVQTPRXQVNR

SEQ ID NO: 743 - protein, 20 aa, Artificial Sequence
  GFR-binding peptide
  MOD_RES (14)..(15): Xaa is C or S
KYLVSIPSMKTPVXXPEPIG

SEQ ID NO: 744 - protein, 20 aa, Artificial Sequence
  GFR-binding peptide
  MOD_RES (14)..(15): Xaa is C or S
KYLVSIPSLETPVXXAKPIS

SEQ ID NO: 745 - protein, 20 aa, Artificial Sequence
  GFR-binding peptide
  MOD_RES (14)..(14): Xaa is C or S
KYLVSIPSLKTPVXTPKTVH

SEQ ID NO: 746 - protein, 20 aa, Artificial Sequence
  GFR-binding peptide
  MOD_RES (14)..(15): Xaa is C or S
KYLVSIPSLKTPVXXPKPVY

SEQ ID NO: 747 - protein, 20 aa, Artificial Sequence
  GFR-binding peptide
  MOD_RES (14)..(15): Xaa is C or S
KYLVSIPSLQTPVXXPKPVT

SEQ ID NO: 748 - protein, 20 aa, Artificial Sequence
  GFR-binding peptide
  MOD_RES (14)..(15): Xaa is C or S
KYLVSIPSLKTPVXXAKPVA

SEQ ID NO: 749 - protein, 20 aa, Artificial Sequence
  GFR-binding peptide
  MOD_RES (14)..(15): Xaa is C or S
KYLVSIPSLKTPVXXAKSAK

SEQ ID NO: 750 - protein, 20 aa, Artificial Sequence
  GFR-binding peptide
  MOD_RES (14)..(15): Xaa is C or S
KYLVSIPSLRTPVXXSAPAA

SEQ ID NO: 751 - protein, 20 aa, Artificial Sequence
  GFR-binding peptide
  MOD_RES (14)..(15): Xaa is C or S
KYLVSIPSLRTPVXXTPPTS

SEQ ID NO: 752 - protein, 20 aa, Artificial Sequence
  GFR-binding peptide
  MOD_RES (14)..(15): Xaa is C or S
KYLVSIPSTKTPVXXTSPVR

SEQ ID NO: 753 - protein, 20 aa, Artificial Sequence
  GFR-binding peptide
  MOD_RES (14)..(15): Xaa is C or S
KYLVSIPSLATPVXXPAASA

SEQ ID NO: 754 - protein, 20 aa, Artificial Sequence
  GFR-binding peptide
  MOD_RES (14)..(15): Xaa is C or S
KYLVSIPSLDTPVXXPSASA

SEQ ID NO: 755 - protein, 20 aa, Artificial Sequence
  GFR-binding peptide
  MOD_RES (14)..(15): Xaa is C or S
KYLVSIPSLDTPVXXPSASA

SEQ ID NO: 756 - protein, 20 aa, Artificial Sequence
  GFR-binding peptide
  MOD_RES (14)..(15): Xaa is C or S
KYLVSIPSMKEPVXXPEPIG

SEQ ID NO: 757 - protein, 20 aa, Artificial Sequence
  GFR-binding peptide
  MOD_RES (14)..(14): Xaa is C or S
KYLVSIPSLKTPAXTPKTVH

SEQ ID NO: 758 - protein, 20 aa, Artificial Sequence
  GFR-binding peptide
  MOD_RES (14)..(15): Xaa is C or S
KYLVSIPSLKTPAXXPKPVY

SEQ ID NO: 759 - protein, 20 aa, Artificial Sequence
  GFR-binding peptide
  MOD_RES (14)..(15): Xaa is C or S
KYLVSIPSLQTPAXXPKPVT

SEQ ID NO: 760 - protein, 20 aa, Artificial Sequence
  GFR-binding peptide
  MOD_RES (14)..(15): Xaa is C or S
KYLVSIPSLKTPAXXAKPVA

SEQ ID NO: 761 - protein, 20 aa, Artificial Sequence
  GFR-binding peptide
  MOD_RES (14)..(15): Xaa is C or S
KYLVSIPSMKTPTXXPGASG

SEQ ID NO: 762 - protein, 20 aa, Artificial Sequence
  GFR-binding peptide
  MOD_RES (14)..(15): Xaa is C or S
KYLVSIPSLRAPVXXSAPAA

SEQ ID NO: 763 - protein, 20 aa, Artificial Sequence
  GFR-binding peptide
  MOD_RES (14)..(15): Xaa is C or S
KYLVSIPSLKTPAXXPKPVH

SEQ ID NO: 764 - protein, 20 aa, Artificial Sequence
  GFR-binding peptide
  MOD_RES (14)..(15): Xaa is C or S
KYLVSIPSTKVPAXXTSPVR

SEQ ID NO: 765 - protein, 20 aa, Artificial Sequence
  GFR-binding peptide
  MOD_RES (14)..(15): Xaa is C or S
KYLVSIPSLAQPVXXPAASA

SEQ ID NO: 766 - protein, 20 aa, Artificial Sequence
  GFR-binding peptide
  MOD_RES (14)..(15): Xaa is C or S
KYLVSIPSLDQSVXXPSASA

SEQ ID NO: 767 - protein, 20 aa, Artificial Sequence
  GFR-binding peptide
  MOD_RES (14)..(15): Xaa is C or S
KYLVSIPSLDQPVXXPSASA

SEQ ID NO: 768 - protein, 20 aa, Artificial Sequence
  GFR-binding peptide
  MOD_RES (16)..(16): Xaa is C or S
KYLVSIPSHHVRSPQXKVSS

SEQ ID NO: 769 - protein, 20 aa, Artificial Sequence
  GFR-binding peptide
  MOD_RES (16)..(16): Xaa is C or S
KYLVSIPSLQVQTPRXQVNR

SEQ ID NO: 770 - protein, 20 aa, Artificial Sequence
  GFR-binding peptide
  MOD_RES (14)..(15): Xaa is C or S
LYLISIPELETPVXXAKPIK

SEQ ID NO: 771 - protein, 20 aa, Artificial Sequence
  GFR-binding peptide
  MOD_RES (14)..(15): Xaa is C or S
LYLISIPEMKTPVXXPEPIG

SEQ ID NO: 772 - protein, 20 aa, Artificial Sequence
  GFR-binding peptide
  MOD_RES (14)..(15): Xaa is C or S
LYLISIPELETPVXXAKPIS

SEQ ID NO: 773 - protein, 20 aa, Artificial Sequence
  GFR-binding peptide
  MOD_RES (14)..(14): Xaa is C or S
LYLISIPELKTPVXTPKTVH

SEQ ID NO: 774 - protein, 20 aa, Artificial Sequence
  GFR-binding peptide
  MOD_RES (14)..(15): Xaa is C or S
LYLISIPELKTPVXXPKPVY

SEQ ID NO: 775 - protein, 20 aa, Artificial Sequence
  GFR-binding peptide
  MOD_RES (14)..(15): Xaa is C or S
LYLISIPELQTPVXXPKPVT

SEQ ID NO: 776 - protein, 20 aa, Artificial Sequence
  GFR-binding peptide
  MOD_RES (14)..(15): Xaa is C or S
LYLISIPELKTPVXXAKPVA

SEQ ID NO: 777 - protein, 20 aa, Artificial Sequence
  GFR-binding peptide
  MOD_RES (14)..(15): Xaa is C or S
LYLISIPEMKTPVXXPGASG

SEQ ID NO: 778 - protein, 20 aa, Artificial Sequence
  GFR-binding peptide
  MOD_RES (14)..(15): Xaa is C or S
LYLISIPELRTPVXXSAPAA

SEQ ID NO: 779 - protein, 20 aa, Artificial Sequence
  GFR-binding peptide
  MOD_RES (14)..(15): Xaa is C or S
LYLISIPELRTPVXXTPPTS

SEQ ID NO: 780 - protein, 20 aa, Artificial Sequence
  GFR-binding peptide
  MOD_RES (14)..(15): Xaa is C or S
LYLISIPELKTPVXXPKPVH

SEQ ID NO: 781 - protein, 20 aa, Artificial Sequence
  GFR-binding peptide
  MOD_RES (14)..(15): Xaa is C or S
LYLISIPETKTPVXXTSPVR

SEQ ID NO: 782 - protein, 20 aa, Artificial Sequence
  GFR-binding peptide
  MOD_RES (14)..(15): Xaa is C or S
LYLISIPELATPVXXPAASA

SEQ ID NO: 783 - protein, 20 aa, Artificial Sequence
  GFR-binding peptide
  MOD_RES (14)..(15): Xaa is C or S
LYLISIPELDTPVXXPSASA

SEQ ID NO: 784 - protein, 20 aa, Artificial Sequence
  GFR-binding peptide
  MOD_RES (14)..(15): Xaa is C or S
LYLISIPELDTPVXXPSASA

SEQ ID NO: 785 - protein, 20 aa, Artificial Sequence
  GFR-binding peptide
  MOD_RES (14)..(15): Xaa is C or S
LYLISIPEMKEPVXXPEPIG

SEQ ID NO: 786 - protein, 20 aa, Artificial Sequence
  GFR-binding peptide
  MOD_RES (14)..(14): Xaa is C or S
LYLISIPELKTPAXTPKTVH

SEQ ID NO: 787 - protein, 20 aa, Artificial Sequence
  GFR-binding peptide
  MOD_RES (14)..(15): Xaa is C or S
LYLISIPELKTPAXXPKPVY

SEQ ID NO: 788 - protein, 20 aa, Artificial Sequence
  GFR-binding peptide
  MOD_RES (14)..(15): Xaa is C or S
LYLISIPELQTPAXXPKPVT

SEQ ID NO: 789 - protein, 20 aa, Artificial Sequence
  GFR-binding peptide
  MOD_RES (14)..(15): Xaa is C or S
LYLISIPEMKTPTXXPGASG

SEQ ID NO: 790 - protein, 20 aa, Artificial Sequence
  GFR-binding peptide
  MOD_RES (14)..(15): Xaa is C or S
LYLISIPELRAPVXXSAPAA

SEQ ID NO: 791 - protein, 20 aa, Artificial Sequence
  GFR-binding peptide
  MOD_RES (14)..(15): Xaa is C or S
LYLISIPELAQPVXXPAASA

SEQ ID NO: 792 - protein, 20 aa, Artificial Sequence
  GFR-binding peptide
  MOD_RES (14)..(15): Xaa is C or S
LYLISIPELDQSVXXPSASA

SEQ ID NO: 793 - protein, 20 aa, Artificial Sequence
  GFR-binding peptide
  MOD_RES (14)..(15): Xaa is C or S
LYLISIPELDQPVXXPSASA

SEQ ID NO: 794 - protein, 20 aa, Artificial Sequence
  GFR-binding peptide
  MOD_RES (16)..(16): Xaa is C or S
LYLISIPEHHVRSPQXKVSS

SEQ ID NO: 795 - protein, 20 aa, Artificial Sequence
  GFR-binding peptide
  MOD_RES (16)..(16): Xaa is C or S
LYLISIPELQVQTPRXQVNR

SEQ ID NO: 796 - protein, 20 aa, Artificial Sequence
  GFR-binding peptide
  MOD_RES (14)..(14): Xaa is C or S
FYLMNIPSLKTPTXTPKTVH

SEQ ID NO: 797 - protein, 20 aa, Artificial Sequence
  GFR-binding peptide
  MOD_RES (14)..(15): Xaa is C or S
FYLMNIPSLQTPTXXPKPVT

SEQ ID NO: 798 - protein, 20 aa, Artificial Sequence
  GFR-binding peptide
  MOD_RES (14)..(15): Xaa is C or S
FYLMNIPSLKTPTXXAKPVA

SEQ ID NO: 799 - protein, 20 aa, Artificial Sequence
  GFR-binding peptide
  MOD_RES (14)..(15): Xaa is C or S
FYLMNIPSLKTPTXXAKGVK

SEQ ID NO: 800 - protein, 20 aa, Artificial Sequence
  GFR-binding peptide
  MOD_RES (14)..(15): Xaa is C or S
FYLMNIPSLKTPTXXAKSAK

SEQ ID NO: 801 - protein, 20 aa, Artificial Sequence
  GFR-binding peptide
  MOD_RES (14)..(15): Xaa is C or S
FYLMNIPSLRTPTXXSAPAA

SEQ ID NO: 802 - protein, 20 aa, Artificial Sequence
  GFR-binding peptide
  MOD_RES (14)..(15): Xaa is C or S
FYLMNIPSLRTPTXXTPPTS

SEQ ID NO: 803 - protein, 20 aa, Artificial Sequence
  GFR-binding peptide
  MOD_RES (14)..(15): Xaa is C or S
FYLMNIPSLKTPTXXPKPVH

SEQ ID NO: 804 - protein, 20 aa, Artificial Sequence
  GFR-binding peptide
  MOD_RES (14)..(15): Xaa is C or S
FYLMNIPSTKTPTXXTSPVR

SEQ ID NO: 805 - protein, 20 aa, Artificial Sequence
  GFR-binding peptide
  MOD_RES (14)..(15): Xaa is C or S
FYLMNIPSLATPTXXPAASA

SEQ ID NO: 806 - protein, 20 aa, Artificial Sequence
  GFR-binding peptide
  MOD_RES (14)..(15): Xaa is C or S
FYLMNIPSLDTPTXXPSASA

SEQ ID NO: 807 - protein, 20 aa, Artificial Sequence
  GFR-binding peptide
  MOD_RES (14)..(15): Xaa is C or S
FYLMNIPSLDTPTXXPSASA

SEQ ID NO: 808 - protein, 20 aa, Artificial Sequence
  GFR-binding peptide
  MOD_RES (14)..(15): Xaa is C or S
FYLMNIPSLETPVXXAKPIK

SEQ ID NO: 809 - protein, 20 aa, Artificial Sequence
  GFR-binding peptide
  MOD_RES (14)..(15): Xaa is C or S
FYLMNIPSMKEPVXXPEPIG

SEQ ID NO: 810 - protein, 20 aa, Artificial Sequence
  GFR-binding peptide
  MOD_RES (14)..(15): Xaa is C or S
FYLMNIPSLETPVXXAKPIS

SEQ ID NO: 811 - protein, 20 aa, Artificial Sequence
  GFR-binding peptide
  MOD_RES (14)..(14): Xaa is C or S
FYLMNIPSLKTPAXTPKTVH

SEQ ID NO: 812 - protein, 20 aa, Artificial Sequence
  GFR-binding peptide
  MOD_RES (14)..(15): Xaa is C or S
FYLMNIPSLKTPAXXPKPVY

SEQ ID NO: 813 - protein, 20 aa, Artificial Sequence
  GFR-binding peptide
  MOD_RES (14)..(15): Xaa is C or S
FYLMNIPSLQTPAXXPKPVT

SEQ ID NO: 814 - protein, 20 aa, Artificial Sequence
  GFR-binding peptide
  MOD_RES (14)..(15): Xaa is C or S
FYLMNIPSLKTPAXXAKPVA

SEQ ID NO: 815 - protein, 20 aa, Artificial Sequence
  GFR-binding peptide
  MOD_RES (14)..(15): Xaa is C or S
FYLMNIPSLKTPVXXAKGVK

SEQ ID NO: 816 - protein, 20 aa, Artificial Sequence
  GFR-binding peptide
  MOD_RES (14)..(15): Xaa is C or S
FYLMNIPSLKTPVXXAKSAK

SEQ ID NO: 817 - protein, 20 aa, Artificial Sequence
  GFR-binding peptide
  MOD_RES (14)..(15): Xaa is C or S
FYLMNIPSLRAPVXXSAPAA

SEQ ID NO: 818 - protein, 20 aa, Artificial Sequence
  GFR-binding peptide
  MOD_RES (14)..(15): Xaa is C or S
FYLMNIPSLRTPVXXTPPTS

SEQ ID NO: 819 - protein, 20 aa, Artificial Sequence
  GFR-binding peptide
  MOD_RES (14)..(15): Xaa is C or S
FYLMNIPSLKTPAXXPKPVH

SEQ ID NO: 820 - protein, 20 aa, Artificial Sequence
  GFR-binding peptide
  MOD_RES (14)..(15): Xaa is C or S
FYLMNIPSTKVPAXXTSPVR

SEQ ID NO: 821 - protein, 20 aa, Artificial Sequence
  GFR-binding peptide
  MOD_RES (14)..(15): Xaa is C or S
FYLMNIPSLAQPVXXPAASA

SEQ ID NO: 822 - protein, 20 aa, Artificial Sequence
  GFR-binding peptide
  MOD_RES (14)..(15): Xaa is C or S
FYLMNIPSLDQSVXXPSASA

SEQ ID NO: 823 - protein, 20 aa, Artificial Sequence
  GFR-binding peptide
  MOD_RES (14)..(15): Xaa is C or S
FYLMNIPSLDQPVXXPSASA

SEQ ID NO: 824 - protein, 20 aa, Artificial Sequence
  GFR-binding peptide
  MOD_RES (14)..(14): Xaa is C or S
FYLMNIPSEETPVXELGEDN

SEQ ID NO: 825 - protein, 20 aa, Artificial Sequence
  GFR-binding peptide
  MOD_RES (14)..(14): Xaa is C or S
FYLMNIPSQGTPVXELGEDN

SEQ ID NO: 826 - protein, 20 aa, Artificial Sequence
  GFR-binding peptide
  MOD_RES (16)..(16): Xaa is C or S
FYLMNIPSHHVRSPQXKVSS

SEQ ID NO: 827 - protein, 20 aa, Artificial Sequence
  GFR-binding peptide
  MOD_RES (16)..(16): Xaa is C or S
FYLMNIPSLQVQTPRXQVNR

SEQ ID NO: 828 - protein, 20 aa, Artificial Sequence
  GFR-binding peptide
  MOD_RES (14)..(15): Xaa is C or S
IYLISIPSLEAPVXXAKPIK

SEQ ID NO: 829 - protein, 20 aa, Artificial Sequence
  GFR-binding peptide
  MOD_RES (14)..(15): Xaa is C or S
IYLISIPSLEAPVXXAKPIS

SEQ ID NO: 830 - protein, 20 aa, Artificial Sequence
  GFR-binding peptide
  MOD_RES (14)..(14): Xaa is C or S
IYLISIPSLKAPVXTPKTVH

SEQ ID NO: 831 - protein, 20 aa, Artificial Sequence
  GFR-binding peptide
  MOD_RES (14)..(15): Xaa is C or S
IYLISIPSLKAPVXXPKPVY

SEQ ID NO: 832 - protein, 20 aa, Artificial Sequence
  GFR-binding peptide
  MOD_RES (14)..(15): Xaa is C or S
IYLISIPSLQAPVXXPKPVT

SEQ ID NO: 833 - protein, 20 aa, Artificial Sequence
  GFR-binding peptide
  MOD_RES (14)..(15): Xaa is C or S
IYLISIPSLKAPVXXAKPVA

SEQ ID NO: 834 - protein, 20 aa, Artificial Sequence
  GFR-binding peptide
  MOD_RES (14)..(15): Xaa is C or S
IYLISIPSLKAPVXXAKGVK

SEQ ID NO: 835 - protein, 20 aa, Artificial Sequence
  GFR-binding peptide
  MOD_RES (14)..(15): Xaa is C or S
IYLISIPSLKAPVXXAKSAK

SEQ ID NO: 836 - protein, 20 aa, Artificial Sequence
  GFR-binding peptide
  MOD_RES (14)..(15): Xaa is C or S
IYLISIPSMKAPVXXPGASG

SEQ ID NO: 837 - protein, 20 aa, Artificial Sequence
  GFR-binding peptide
  MOD_RES (14)..(15): Xaa is C or S
IYLISIPSLRAPVXXTPPTS

SEQ ID NO: 838 - protein, 20 aa, Artificial Sequence
  GFR-binding peptide
  MOD_RES (14)..(15): Xaa is C or S
IYLISIPSLKAPVXXPKPVH

SEQ ID NO: 839 - protein, 20 aa, Artificial Sequence
  GFR-binding peptide
  MOD_RES (14)..(15): Xaa is C or S
IYLISIPSLDAPVXXPSASA

SEQ ID NO: 840 - protein, 20 aa, Artificial Sequence
  GFR-binding peptide
  MOD_RES (14)..(15): Xaa is C or S
IYLISIPSLDAPVXXPSASA

SEQ ID NO: 841 - protein, 20 aa, Artificial Sequence
  GFR-binding peptide
  MOD_RES (14)..(15): Xaa is C or S
IYLISIPSLETPVXXAKPIK

SEQ ID NO: 842 - protein, 20 aa, Artificial Sequence
  GFR-binding peptide
  MOD_RES (14)..(15): Xaa is C or S
IYLISIPSMKEPVXXPEPIG

SEQ ID NO: 843 - protein, 20 aa, Artificial Sequence
  GFR-binding peptide
  MOD_RES (14)..(15): Xaa is C or S
IYLISIPSLETPVXXAKPIS

SEQ ID NO: 844 - protein, 20 aa, Artificial Sequence
  GFR-binding peptide
  MOD_RES (14)..(14): Xaa is C or S
IYLISIPSLKTPAXTPKTVH

SEQ ID NO: 845 - protein, 20 aa, Artificial Sequence
  GFR-binding peptide
  MOD_RES (14)..(15): Xaa is C or S
IYLISIPSLKTPAXXPKPVY

SEQ ID NO: 846 - protein, 20 aa, Artificial Sequence
  GFR-binding peptide
  MOD_RES (14)..(15): Xaa is C or S
IYLISIPSLQTPAXXPKPVT

SEQ ID NO: 847 - protein, 20 aa, Artificial Sequence
  GFR-binding peptide
  MOD_RES (14)..(15): Xaa is C or S
IYLISIPSLKTPAXXAKPVA

SEQ ID NO: 848 - protein, 20 aa, Artificial Sequence
  GFR-binding peptide
  MOD_RES (14)..(15): Xaa is C or S
IYLISIPSLKTPVXXAKGVK

SEQ ID NO: 849 - protein, 20 aa, Artificial Sequence
  GFR-binding peptide
  MOD_RES (14)..(15): Xaa is C or S
IYLISIPSLKTPVXXAKSAK

SEQ ID NO: 850 - protein, 20 aa, Artificial Sequence
  GFR-binding peptide
  MOD_RES (14)..(15): Xaa is C or S
IYLISIPSMKTPTXXPGASG

SEQ ID NO: 851 - protein, 20 aa, Artificial Sequence
  GFR-binding peptide
  MOD_RES (14)..(15): Xaa is C or S
IYLISIPSLRTPVXXTPPTS

SEQ ID NO: 852 - protein, 20 aa, Artificial Sequence
  GFR-binding peptide
  MOD_RES (14)..(15): Xaa is C or S
IYLISIPSLKTPAXXPKPVH

SEQ ID NO: 853 - protein, 20 aa, Artificial Sequence
  GFR-binding peptide
  MOD_RES (14)..(15): Xaa is C or S
IYLISIPSTKVPAXXTSPVR

SEQ ID NO: 854 - protein, 20 aa, Artificial Sequence
  GFR-binding peptide
  MOD_RES (14)..(15): Xaa is C or S
IYLISIPSLAQPVXXPAASA

SEQ ID NO: 855 - protein, 20 aa, Artificial Sequence
  GFR-binding peptide
  MOD_RES (14)..(15): Xaa is C or S
IYLISIPSLDQSVXXPSASA

SEQ ID NO: 856 - protein, 20 aa, Artificial Sequence
  GFR-binding peptide
  MOD_RES (14)..(15): Xaa is C or S
IYLISIPSLDQPVXXPSASA

SEQ ID NO: 857 - protein, 20 aa, Artificial Sequence
  GFR-binding peptide
  MOD_RES (14)..(14): Xaa is C or S
IYLISIPSQGTPVXELGEDN

SEQ ID NO: 858 - protein, 20 aa, Artificial Sequence
  GFR-binding peptide
  MOD_RES (16)..(16): Xaa is C or S
IYLISIPSHHVRSPQXKVSS

SEQ ID NO: 859 - protein, 20 aa, Artificial Sequence
  GFR-binding peptide
  MOD_RES (16)..(16): Xaa is C or S
IYLISIPSLQVQTPRXQVNR

SEQ ID NO: 860 - protein, 20 aa, Artificial Sequence
  GFR-binding peptide
  MOD_RES (14)..(15): Xaa is C or S
IFLISIPSLETPVXXAKPIK

SEQ ID NO: 861 - protein, 20 aa, Artificial Sequence
  GFR-binding peptide
  MOD_RES (14)..(15): Xaa is C or S
IFLISIPSMKTPVXXPEPIG

SEQ ID NO: 862 - protein, 20 aa, Artificial Sequence
  GFR-binding peptide
  MOD_RES (14)..(15): Xaa is C or S
IFLISIPSLETPVXXAKPIS

SEQ ID NO: 863 - protein, 20 aa, Artificial Sequence
  GFR-binding peptide
  MOD_RES (14)..(14): Xaa is C or S
IFLISIPSLKTPVXTPKTVH

SEQ ID NO: 864 - protein, 20 aa, Artificial Sequence
  GFR-binding peptide
  MOD_RES (14)..(15): Xaa is C or S
IFLISIPSLKTPVXXPKPVY

SEQ ID NO: 865 - protein, 20 aa, Artificial Sequence
  GFR-binding peptide
  MOD_RES (14)..(15): Xaa is C or S
IFLISIPSLQTPVXXPKPVT

SEQ ID NO: 866 - protein, 20 aa, Artificial Sequence
  GFR-binding peptide
  MOD_RES (14)..(15): Xaa is C or S
IFLISIPSLKTPVXXAKPVA

SEQ ID NO: 867 - protein, 20 aa, Artificial Sequence
  GFR-binding peptide
  MOD_RES (14)..(15): Xaa is C or S
IFLISIPSLKTPVXXAKGVK

SEQ ID NO: 868 - protein, 20 aa, Artificial Sequence
  GFR-binding peptide
  MOD_RES (14)..(15): Xaa is C or S
IFLISIPSLKTPVXXAKSAK

SEQ ID NO: 869 - protein, 20 aa, Artificial Sequence
  GFR-binding peptide
  MOD_RES (14)..(15): Xaa is C or S
IFLISIPSMKTPVXXPGASG

SEQ ID NO: 870 - protein, 20 aa, Artificial Sequence
  GFR-binding peptide
  MOD_RES (14)..(15): Xaa is C or S
IFLISIPSLRTPVXXSAPAA

SEQ ID NO: 871 - protein, 20 aa, Artificial Sequence
  GFR-binding peptide
  MOD_RES (14)..(15): Xaa is C or S
IFLISIPSLKTPVXXPKPVH

SEQ ID NO: 872 - protein, 20 aa, Artificial Sequence
  GFR-binding peptide
  MOD_RES (14)..(15): Xaa is C or S
IFLISIPSTKTPVXXTSPVR

SEQ ID NO: 873 - protein, 20 aa, Artificial Sequence
  GFR-binding peptide
  MOD_RES (14)..(15): Xaa is C or S
IFLISIPSLATPVXXPAASA

SEQ ID NO: 874 - protein, 20 aa, Artificial Sequence
  GFR-binding peptide
  MOD_RES (14)..(15): Xaa is C or S
IFLISIPSLDTPVXXPSASA

SEQ ID NO: 875 - protein, 20 aa, Artificial Sequence
  GFR-binding peptide
  MOD_RES (14)..(15): Xaa is C or S
IFLISIPSLDTPVXXPSASA

SEQ ID NO: 876 - protein, 20 aa, Artificial Sequence
  GFR-binding peptide
  MOD_RES (14)..(15): Xaa is C or S
IFLISIPSMKEPVXXPEPIG

SEQ ID NO: 877 - protein, 20 aa, Artificial Sequence
  GFR-binding peptide
  MOD_RES (14)..(14): Xaa is C or S
IFLISIPSLKTPAXTPKTVH

SEQ ID NO: 878 - protein, 20 aa, Artificial Sequence
  GFR-binding peptide
  MOD_RES (14)..(15): Xaa is C or S
IFLISIPSLKTPAXXPKPVY

SEQ ID NO: 879 - protein, 20 aa, Artificial Sequence
  GFR-binding peptide
  MOD_RES (14)..(15): Xaa is C or S
IFLISIPSLQTPAXXPKPVT

SEQ ID NO: 880 - protein, 20 aa, Artificial Sequence
  GFR-binding peptide
  MOD_RES (14)..(15): Xaa is C or S
IFLISIPSLKTPAXXAKPVA

SEQ ID NO: 881 - protein, 20 aa, Artificial Sequence
  GFR-binding peptide
  MOD_RES (14)..(15): Xaa is C or S
IFLISIPSMKTPTXXPGASG

SEQ ID NO: 882 - protein, 20 aa, Artificial Sequence
  GFR-binding peptide
  MOD_RES (14)..(15): Xaa is C or S
IFLISIPSLRAPVXXSAPAA

SEQ ID NO: 883 - protein, 20 aa, Artificial Sequence
  GFR-binding peptide
  MOD_RES (14)..(15): Xaa is C or S
IFLISIPSLKTPAXXPKPVH

SEQ ID NO: 884 - protein, 20 aa, Artificial Sequence
  GFR-binding peptide
  MOD_RES (14)..(15): Xaa is C or S
IFLISIPSTKVPAXXTSPVR

SEQ ID NO: 885 - protein, 20 aa, Artificial Sequence
  GFR-binding peptide
  MOD_RES (14)..(15): Xaa is C or S
IFLISIPSLAQPVXXPAASA

SEQ ID NO: 886 - protein, 20 aa, Artificial Sequence
  GFR-binding peptide
  MOD_RES (14)..(15): Xaa is C or S
IFLISIPSLDQSVXXPSASA

SEQ ID NO: 887 - protein, 20 aa, Artificial Sequence
  GFR-binding peptide
  MOD_RES (14)..(15): Xaa is C or S
IFLISIPSLDQPVXXPSASA

SEQ ID NO: 888 - protein, 20 aa, Artificial Sequence
  GFR-binding peptide
  MOD_RES (14)..(15): Xaa is C or S
VYLMSLPKLEVPAXXAKPIK

SEQ ID NO: 889 - protein, 20 aa, Artificial Sequence
  GFR-binding peptide
  MOD_RES (14)..(15): Xaa is C or S
VYLMSLPKMKVPAXXPEPIG

SEQ ID NO: 890 - protein, 20 aa, Artificial Sequence
  GFR-binding peptide
  MOD_RES (14)..(15): Xaa is C or S
VYLMSLPKLEVPAXXAKPIS

SEQ ID NO: 891 - protein, 20 aa, Artificial Sequence
  GFR-binding peptide
  MOD_RES (14)..(14): Xaa is C or S
VYLMSLPKLKVPAXTPKTVH

SEQ ID NO: 892 - protein, 20 aa, Artificial Sequence
  GFR-binding peptide
  MOD_RES (14)..(15): Xaa is C or S
VYLMSLPKLKVPAXXPKPVY

SEQ ID NO: 893 - protein, 20 aa, Artificial Sequence
  GFR-binding peptide
  MOD_RES (14)..(15): Xaa is C or S
VYLMSLPKLQVPAXXPKPVT

SEQ ID NO: 894 - protein, 20 aa, Artificial Sequence
  GFR-binding peptide
  MOD_RES (14)..(15): Xaa is C or S
VYLMSLPKLKVPAXXAKPVA

SEQ ID NO: 895 - protein, 20 aa, Artificial Sequence
  GFR-binding peptide
  MOD_RES (14)..(15): Xaa is C or S
VYLMSLPKLKVPAXXAKGVK

SEQ ID NO: 896 - protein, 20 aa, Artificial Sequence
  GFR-binding peptide
  MOD_RES (14)..(15): Xaa is C or S
VYLMSLPKLKVPAXXAKSAK

SEQ ID NO: 897 - protein, 20 aa, Artificial Sequence
  GFR-binding peptide
  MOD_RES (14)..(15): Xaa is C or S
VYLMSLPKMKVPAXXPGASG

SEQ ID NO: 898 - protein, 20 aa, Artificial Sequence
  GFR-binding peptide
  MOD_RES (14)..(15): Xaa is C or S
VYLMSLPKLRVPAXXSAPAA

SEQ ID NO: 899 - protein, 20 aa, Artificial Sequence
  GFR-binding peptide
  MOD_RES (14)..(15): Xaa is C or S
VYLMSLPKLRVPAXXTPPTS

SEQ ID NO: 900 - protein, 20 aa, Artificial Sequence
  GFR-binding peptide
  MOD_RES (14)..(15): Xaa is C or S
VYLMSLPKLKVPAXXPKPVH

SEQ ID NO: 901 - protein, 20 aa, Artificial Sequence
  GFR-binding peptide
  MOD_RES (14)..(15): Xaa is C or S
VYLMSLPKLAVPAXXPAASA

SEQ ID NO: 902 - protein, 20 aa, Artificial Sequence
  GFR-binding peptide
  MOD_RES (14)..(15): Xaa is C or S
VYLMSLPKLDVPAXXPSASA

SEQ ID NO: 903 - protein, 20 aa, Artificial Sequence
  GFR-binding peptide
  MOD_RES (14)..(15): Xaa is C or S
VYLMSLPKLDVPAXXPSASA

SEQ ID NO: 904 - protein, 20 aa, Artificial Sequence
  GFR-binding peptide
  MOD_RES (14)..(15): Xaa is C or S
VYLMSLPKLETPVXXAKPIK

SEQ ID NO: 905 - protein, 20 aa, Artificial Sequence
  GFR-binding peptide
  MOD_RES (14)..(15): Xaa is C or S
VYLMSLPKMKEPVXXPEPIG

SEQ ID NO: 906 - protein, 20 aa, Artificial Sequence
  GFR-binding peptide
  MOD_RES (14)..(15): Xaa is C or S
VYLMSLPKLETPVXXAKPIS

SEQ ID NO: 907 - protein, 20 aa, Artificial Sequence
  GFR-binding peptide
  MOD_RES (14)..(14): Xaa is C or S
VYLMSLPKLKTPAXTPKTVH

SEQ ID NO: 908 - protein, 20 aa, Artificial Sequence
  GFR-binding peptide
  MOD_RES (14)..(15): Xaa is C or S
VYLMSLPKLKTPAXXPKPVY

SEQ ID NO: 909 - protein, 20 aa, Artificial Sequence
  GFR-binding peptide
  MOD_RES (14)..(15): Xaa is C or S
VYLMSLPKLQTPAXXPKPVT

SEQ ID NO: 910 - protein, 20 aa, Artificial Sequence
  GFR-binding peptide
  MOD_RES (14)..(15): Xaa is C or S
VYLMSLPKLKTPAXXAKPVA

SEQ ID NO: 911 - protein, 20 aa, Artificial Sequence
  GFR-binding peptide
  MOD_RES (14)..(15): Xaa is C or S
VYLMSLPKLKTPVXXAKGVK

SEQ ID NO: 912 - protein, 20 aa, Artificial Sequence
  GFR-binding peptide
  MOD_RES (14)..(15): Xaa is C or S
VYLMSLPKLKTPVXXAKSAK

SEQ ID NO: 913 - protein, 20 aa, Artificial Sequence
  GFR-binding peptide
  MOD_RES (14)..(15): Xaa is C or S
VYLMSLPKMKTPTXXPGASG

SEQ ID NO: 914 - protein, 20 aa, Artificial Sequence
  GFR-binding peptide
  MOD_RES (14)..(15): Xaa is C or S
VYLMSLPKLRAPVXXSAPAA

SEQ ID NO: 915 - protein, 20 aa, Artificial Sequence
  GFR-binding peptide
  MOD_RES (14)..(15): Xaa is C or S
VYLMSLPKLRTPVXXTPPTS

SEQ ID NO: 916 - protein, 20 aa, Artificial Sequence
  GFR-binding peptide
  MOD_RES (14)..(15): Xaa is C or S
VYLMSLPKLKTPAXXPKPVH

SEQ ID NO: 917 - protein, 20 aa, Artificial Sequence
  GFR-binding peptide
  MOD_RES (14)..(15): Xaa is C or S
VYLMSLPKLAQPVXXPAASA

SEQ ID NO: 918 - protein, 20 aa, Artificial Sequence
  GFR-binding peptide
  MOD_RES (14)..(15): Xaa is C or S
VYLMSLPKLDQSVXXPSASA

SEQ ID NO: 919 - protein, 20 aa, Artificial Sequence
  GFR-binding peptide
  MOD_RES (14)..(15): Xaa is C or S
VYLMSLPKLDQPVXXPSASA

SEQ ID NO: 920 - protein, 20 aa, Artificial Sequence
  GFR-binding peptide
  MOD_RES (14)..(14): Xaa is C or S
VYLMSLPKEETPVXELGEDN

SEQ ID NO: 921 - protein, 20 aa, Artificial Sequence
  GFR-binding peptide
  MOD_RES (14)..(14): Xaa is C or S
VYLMSLPKQGTPVXELGEDN

SEQ ID NO: 922 - protein, 20 aa, Artificial Sequence
  GFR-binding peptide
  MOD_RES (14)..(14): Xaa is C or S
YYVIPLPELKQPVXTPKTVH

SEQ ID NO: 923 - protein, 20 aa, Artificial Sequence
  GFR-binding peptide
  MOD_RES (14)..(15): Xaa is C or S
YYVIPLPELKQPVXXPKPVY

SEQ ID NO: 924 - protein, 20 aa, Artificial Sequence
  GFR-binding peptide
  MOD_RES (14)..(15): Xaa is C or S
YYVIPLPELQQPVXXPKPVT

SEQ ID NO: 925 - protein, 20 aa, Artificial Sequence
  GFR-binding peptide
  MOD_RES (14)..(15): Xaa is C or S
YYVIPLPELKQPVXXAKPVA

SEQ ID NO: 926 - protein, 20 aa, Artificial Sequence
  GFR-binding peptide
  MOD_RES (14)..(15): Xaa is C or S
YYVIPLPEMKQPVXXPGASG

SEQ ID NO: 927 - protein, 20 aa, Artificial Sequence
  GFR-binding peptide
  MOD_RES (14)..(15): Xaa is C or S
YYVIPLPELRQPVXXSAPAA

SEQ ID NO: 928 - protein, 20 aa, Artificial Sequence
  GFR-binding peptide
  MOD_RES (14)..(15): Xaa is C or S
YYVIPLPELRQPVXXTPPTS

SEQ ID NO: 929 - protein, 20 aa, Artificial Sequence
  GFR-binding peptide
  MOD_RES (14)..(15): Xaa is C or S
YYVIPLPELKQPVXXPKPVH

SEQ ID NO: 930 - protein, 20 aa, Artificial Sequence
  GFR-binding peptide
  MOD_RES (14)..(15): Xaa is C or S
YYVIPLPETKQPVXXTSPVR

SEQ ID NO: 931 - protein, 20 aa, Artificial Sequence
  GFR-binding peptide
  MOD_RES (14)..(15): Xaa is C or S
YYVIPLPELDQPVXXPSASA

SEQ ID NO: 932 - protein, 20 aa, Artificial Sequence
  GFR-binding peptide
  MOD_RES (14)..(15): Xaa is C or S
YYVIPLPELDQPVXXPSASA

SEQ ID NO: 933 - protein, 20 aa, Artificial Sequence
  GFR-binding peptide
  MOD_RES (14)..(15): Xaa is C or S
YYVIPLPELETPVXXAKPIK

SEQ ID NO: 934 - protein, 20 aa, Artificial Sequence
  GFR-binding peptide
  MOD_RES (14)..(15): Xaa is C or S
YYVIPLPEMKEPVXXPEPIG

SEQ ID NO: 935 - protein, 20 aa, Artificial Sequence
  GFR-binding peptide
  MOD_RES (14)..(15): Xaa is C or S
YYVIPLPELETPVXXAKPIS

SEQ ID NO: 936 - protein, 20 aa, Artificial Sequence
  GFR-binding peptide
  MOD_RES (14)..(14): Xaa is C or S
YYVIPLPELKTPAXTPKTVH

SEQ ID NO: 937 - protein, 20 aa, Artificial Sequence
  GFR-binding peptide
  MOD_RES (14)..(15): Xaa is C or S
YYVIPLPELKTPAXXPKPVY

SEQ ID NO: 938 - protein, 20 aa, Artificial Sequence
  GFR-binding peptide
  MOD_RES (14)..(15): Xaa is C or S
YYVIPLPELQTPAXXPKPVT

SEQ ID NO: 939 - protein, 20 aa, Artificial Sequence
  GFR-binding peptide
  MOD_RES (14)..(15): Xaa is C or S
YYVIPLPELKTPVXXAKGVK

SEQ ID NO: 940 - protein, 20 aa, Artificial Sequence
  GFR-binding peptide
  MOD_RES (14)..(15): Xaa is C or S
YYVIPLPELKTPVXXAKSAK

SEQ ID NO: 941 - protein, 20 aa, Artificial Sequence
  GFR-binding peptide
  MOD_RES (14)..(15): Xaa is C or S
YYVIPLPEMKTPTXXPGASG

SEQ ID NO: 942 - protein, 20 aa, Artificial Sequence
  GFR-binding peptide
  MOD_RES (14)..(15): Xaa is C or S
YYVIPLPELRAPVXXSAPAA

SEQ ID NO: 943 - protein, 20 aa, Artificial Sequence
  GFR-binding peptide
  MOD_RES (14)..(15): Xaa is C or S
YYVIPLPELRTPVXXTPPTS

SEQ ID NO: 944 - protein, 20 aa, Artificial Sequence
  GFR-binding peptide
  MOD_RES (14)..(15): Xaa is C or S
YYVIPLPELKTPAXXPKPVH

SEQ ID NO: 945 - protein, 20 aa, Artificial Sequence
  GFR-binding peptide
  MOD_RES (14)..(15): Xaa is C or S
YYVIPLPETKVPAXXTSPVR

SEQ ID NO: 946 - protein, 20 aa, Artificial Sequence
  GFR-binding peptide
  MOD_RES (14)..(15): Xaa is C or S
YYVIPLPELDQSVXXPSASA

SEQ ID NO: 947 - protein, 20 aa, Artificial Sequence
  GFR-binding peptide
  MOD_RES (14)..(14): Xaa is C or S
YYVIPLPEEETPVXELGEDN

SEQ ID NO: 948 - protein, 20 aa, Artificial Sequence
  GFR-binding peptide
  MOD_RES (14)..(14): Xaa is C or S
YYVIPLPEQGTPVXELGEDN

SEQ ID NO: 949 - protein, 20 aa, Artificial Sequence
  GFR-binding peptide
  MOD_RES (16)..(16): Xaa is C or S
YYVIPLPEHHVRSPQXKVSS

SEQ ID NO: 950 - protein, 20 aa, Artificial Sequence
  GFR-binding peptide
  MOD_RES (16)..(16): Xaa is C or S
YYVIPLPELQVQTPRXQVNR

SEQ ID NO: 951 - protein, 20 aa, Artificial Sequence
  GFR-binding peptide
  MOD_RES (14)..(15): Xaa is C or S
YYLITLPEMKQSVXXPEPIG

SEQ ID NO: 952 - protein, 20 aa, Artificial Sequence
  GFR-binding peptide
  MOD_RES (14)..(15): Xaa is C or S
YYLITLPELEQSVXXAKPIS

SEQ ID NO: 953 - protein, 20 aa, Artificial Sequence
  GFR-binding peptide
  MOD_RES (14)..(14): Xaa is C or S
YYLITLPELKQSVXTPKTVH

SEQ ID NO: 954 - protein, 20 aa, Artificial Sequence
  GFR-binding peptide
  MOD_RES (14)..(15): Xaa is C or S
YYLITLPELKQSVXXPKPVY

SEQ ID NO: 955 - protein, 20 aa, Artificial Sequence
  GFR-binding peptide
  MOD_RES (14)..(15): Xaa is C or S
YYLITLPELQQSVXXPKPVT

SEQ ID NO: 956 - protein, 20 aa, Artificial Sequence
  GFR-binding peptide
  MOD_RES (14)..(15): Xaa is C or S
YYLITLPELKQSVXXAKPVA

SEQ ID NO: 957 - protein, 20 aa, Artificial Sequence
  GFR-binding peptide
  MOD_RES (14)..(15): Xaa is C or S
YYLITLPELKQSVXXAKSAK

SEQ ID NO: 958 - protein, 20 aa, Artificial Sequence
  GFR-binding peptide
  MOD_RES (14)..(15): Xaa is C or S
YYLITLPEMKQSVXXPGASG

SEQ ID NO: 959 - protein, 20 aa, Artificial Sequence
  GFR-binding peptide
  MOD_RES (14)..(15): Xaa is C or S
YYLITLPELRQSVXXSAPAA

SEQ ID NO: 960 - protein, 20 aa, Artificial Sequence
  GFR-binding peptide
  MOD_RES (14)..(15): Xaa is C or S
YYLITLPELRQSVXXTPPTS

SEQ ID NO: 961 - protein, 20 aa, Artificial Sequence
  GFR-binding peptide
  MOD_RES (14)..(15): Xaa is C or S
YYLITLPELKQSVXXPKPVH

SEQ ID NO: 962 - protein, 20 aa, Artificial Sequence
  GFR-binding peptide
  MOD_RES (14)..(15): Xaa is C or S
YYLITLPETKQSVXXTSPVR

SEQ ID NO: 963 - protein, 20 aa, Artificial Sequence
  GFR-binding peptide
  MOD_RES (14)..(15): Xaa is C or S
YYLITLPELAQSVXXPAASA

SEQ ID NO: 964 - protein, 20 aa, Artificial Sequence
  GFR-binding peptide
  MOD_RES (14)..(15): Xaa is C or S
YYLITLPELETPVXXAKPIK

SEQ ID NO: 965 - protein, 20 aa, Artificial Sequence
  GFR-binding peptide
  MOD_RES (14)..(15): Xaa is C or S
YYLITLPEMKEPVXXPEPIG

SEQ ID NO: 966 - protein, 20 aa, Artificial Sequence
  GFR-binding peptide
  MOD_RES (14)..(15): Xaa is C or S
YYLITLPELETPVXXAKPIS

SEQ ID NO: 967 - protein, 20 aa, Artificial Sequence
  GFR-binding peptide
  MOD_RES (14)..(14): Xaa is C or S
YYLITLPELKTPAXTPKTVH

SEQ ID NO: 968 - protein, 20 aa, Artificial Sequence
  GFR-binding peptide
  MOD_RES (14)..(15): Xaa is C or S
YYLITLPELKTPAXXPKPVY

SEQ ID NO: 969 - protein, 20 aa, Artificial Sequence
  GFR-binding peptide
  MOD_RES (14)..(15): Xaa is C or S
YYLITLPELQTPAXXPKPVT

SEQ ID NO: 970 - protein, 20 aa, Artificial Sequence
  GFR-binding peptide
  MOD_RES (14)..(15): Xaa is C or S
YYLITLPELKTPAXXAKPVA

SEQ ID NO: 971 - protein, 20 aa, Artificial Sequence
  GFR-binding peptide
  MOD_RES (14)..(15): Xaa is C or S
YYLITLPELKTPVXXAKSAK

SEQ ID NO: 972 - protein, 20 aa, Artificial Sequence
  GFR-binding peptide
  MOD_RES (14)..(15): Xaa is C or S
YYLITLPEMKTPTXXPGASG

SEQ ID NO: 973 - protein, 20 aa, Artificial Sequence
  GFR-binding peptide
  MOD_RES (14)..(15): Xaa is C or S
YYLITLPELRAPVXXSAPAA

SEQ ID NO: 974 - protein, 20 aa, Artificial Sequence
  GFR-binding peptide
  MOD_RES (14)..(15): Xaa is C or S
YYLITLPELRTPVXXTPPTS

SEQ ID NO: 975 - protein, 20 aa, Artificial Sequence
  GFR-binding peptide
  MOD_RES (14)..(15): Xaa is C or S
YYLITLPELKTPAXXPKPVH

SEQ ID NO: 976 - protein, 20 aa, Artificial Sequence
  GFR-binding peptide
  MOD_RES (14)..(15): Xaa is C or S
YYLITLPETKVPAXXTSPVR

SEQ ID NO: 977 - protein, 20 aa, Artificial Sequence
  GFR-binding peptide
  MOD_RES (14)..(14): Xaa is C or S
YYLITLPEQGTPVXELGEDN

SEQ ID NO: 978 - protein, 20 aa, Artificial Sequence
  GFR-binding peptide
  MOD_RES (16)..(16): Xaa is C or S
YYLITLPEHHVRSPQXKVSS

SEQ ID NO: 979 - protein, 20 aa, Artificial Sequence
  GFR-binding peptide
  MOD_RES (16)..(16): Xaa is C or S
YYLITLPELQVQTPRXQVNR

SEQ ID NO: 980 - protein, 20 aa, Artificial Sequence
  GFR-binding peptide
  MOD_RES (14)..(15): Xaa is C or S
YYLITLPELEQPVXXAKPIK

SEQ ID NO: 981 - protein, 20 aa, Artificial Sequence
  GFR-binding peptide
  MOD_RES (14)..(15): Xaa is C or S
YYLITLPEMKQPVXXPEPIG

SEQ ID NO: 982 - protein, 20 aa, Artificial Sequence
  GFR-binding peptide
  MOD_RES (14)..(15): Xaa is C or S
YYLITLPELEQPVXXAKPIS

SEQ ID NO: 983 - protein, 20 aa, Artificial Sequence
  GFR-binding peptide
  MOD_RES (14)..(14): Xaa is C or S
YYLITLPELKQPVXTPKTVH

SEQ ID NO: 984 - protein, 20 aa, Artificial Sequence
  GFR-binding peptide
  MOD_RES (14)..(15): Xaa is C or S
YYLITLPELKQPVXXPKPVY

SEQ ID NO: 985 - protein, 20 aa, Artificial Sequence
  GFR-binding peptide
  MOD_RES (14)..(15): Xaa is C or S
YYLITLPELQQPVXXPKPVT

SEQ ID NO: 986 - protein, 20 aa, Artificial Sequence
  GFR-binding peptide
  MOD_RES (14)..(15): Xaa is C or S
YYLITLPELKQPVXXAKPVA

SEQ ID NO: 987 - protein, 20 aa, Artificial Sequence
  GFR-binding peptide
  MOD_RES (14)..(15): Xaa is C or S
YYLITLPELKQPVXXAKGVK

SEQ ID NO: 988 - protein, 20 aa, Artificial Sequence
  GFR-binding peptide
  MOD_RES (14)..(15): Xaa is C or S
YYLITLPELKQPVXXAKSAK

SEQ ID NO: 989 - protein, 20 aa, Artificial Sequence
  GFR-binding peptide
  MOD_RES (14)..(15): Xaa is C or S
YYLITLPEMKQPVXXPGASG

SEQ ID NO: 990 - protein, 20 aa, Artificial Sequence
  GFR-binding peptide
  MOD_RES (14)..(15): Xaa is C or S
YYLITLPELRQPVXXSAPAA

SEQ ID NO: 991 - protein, 20 aa, Artificial Sequence
  GFR-binding peptide
  MOD_RES (14)..(15): Xaa is C or S
YYLITLPELRQPVXXTPPTS

SEQ ID NO: 992 - protein, 20 aa, Artificial Sequence
  GFR-binding peptide
  MOD_RES (14)..(15): Xaa is C or S
YYLITLPELKQPVXXPKPVH

SEQ ID NO: 993 - protein, 20 aa, Artificial Sequence
  GFR-binding peptide
  MOD_RES (14)..(15): Xaa is C or S
YYLITLPETKQPVXXTSPVR

SEQ ID NO: 994 - protein, 20 aa, Artificial Sequence
  GFR-binding peptide
  MOD_RES (14)..(15): Xaa is C or S
YYLITLPELDQPVXXPSASA

SEQ ID NO: 995 - protein, 20 aa, Artificial Sequence
  GFR-binding peptide
  MOD_RES (14)..(14): Xaa is C or S
MIQMTINSQGTPVXELGEDN

SEQ ID NO: 996 - protein, 20 aa, Artificial Sequence
  GFR-binding peptide
  MOD_RES (14)..(15): Xaa is C or S
MIQMTINSMKEPVXXPEPIG

SEQ ID NO: 997 - protein, 20 aa, Artificial Sequence
  GFR-binding peptide
  MOD_RES (14)..(14): Xaa is C or S
MIQMTINSLKTPAXTPKTVH

SEQ ID NO: 998 - protein, 20 aa, Artificial Sequence
  GFR-binding peptide
  MOD_RES (14)..(15): Xaa is C or S
MIQMTINSLKTPAXXPKPVY

SEQ ID NO: 999 - protein, 20 aa, Artificial Sequence
  GFR-binding peptide
  MOD_RES (14)..(15): Xaa is C or S
MIQMTINSLQTPAXXPKPVT

SEQ ID NO: 1000 - protein, 20 aa, Artificial Sequence
  GFR-binding peptide
  MOD_RES (14)..(15): Xaa is C or S
MIQMTINSLKTPAXXAKPVA

SEQ ID NO: 1001 - protein, 20 aa, Artificial Sequence
  GFR-binding peptide
  MOD_RES (14)..(15): Xaa is C or S
MIQMTINSLKTPAXXPKPVH

SEQ ID NO: 1002 - protein, 20 aa, Artificial Sequence
  GFR-binding peptide
  MOD_RES (14)..(15): Xaa is C or S
MIQMTINSTKVPAXXTSPVR

SEQ ID NO: 1003 - protein, 20 aa, Artificial Sequence
  GFR-binding peptide
  MOD_RES (14)..(15): Xaa is C or S
MIQMTINSLAQPVXXPAASA

SEQ ID NO: 1004 - protein, 20 aa, Artificial Sequence
  GFR-binding peptide
  MOD_RES (14)..(15): Xaa is C or S
MIQMTINSLDQSVXXPSASA

SEQ ID NO: 1005 - protein, 20 aa, Artificial Sequence
  GFR-binding peptide
  MOD_RES (14)..(15): Xaa is C or S
MIQMTINSLDQPVXXPSASA

SEQ ID NO: 1006 - protein, 20 aa, Artificial Sequence
  GFR-binding peptide
  MOD_RES (16)..(16): Xaa is C or S
MIQMTINSHHVRSPQXKVSS

SEQ ID NO: 1007 - protein, 20 aa, Artificial Sequence
  GFR-binding peptide
  MOD_RES (16)..(16): Xaa is C or S
MIQMTINSLQVQTPRXQVNR

SEQ ID NO: 1008 - protein, 20 aa, Artificial Sequence
  GFR-binding peptide
  MOD_RES (16)..(16): Xaa is C or S
VKAVKVSRLQVRSPRXQVNR

SEQ ID NO: 1009 - protein, 20 aa, Artificial Sequence
  GFR-binding peptide
  MOD_RES (14)..(15): Xaa is C or S
VKAVKVSRLETPVXXAKPIK

SEQ ID NO: 1010 - protein, 20 aa, Artificial Sequence
  GFR-binding peptide
  MOD_RES (14)..(15): Xaa is C or S
VKAVKVSRMKEPVXXPEPIG

SEQ ID NO: 1011 - protein, 20 aa, Artificial Sequence
  GFR-binding peptide
  MOD_RES (14)..(15): Xaa is C or S
VKAVKVSRLKTPAXXPKPVY

SEQ ID NO: 1012 - protein, 20 aa, Artificial Sequence
  GFR-binding peptide
  MOD_RES (14)..(15): Xaa is C or S
VKAVKVSRLKTPAXXAKPVA

SEQ ID NO: 1013 - protein, 20 aa, Artificial Sequence
  GFR-binding peptide
  MOD_RES (14)..(15): Xaa is C or S
VKAVKVSRLKTPVXXAKGVK

SEQ ID NO: 1014 - protein, 20 aa, Artificial Sequence
  GFR-binding peptide
  MOD_RES (14)..(15): Xaa is C or S
VKAVKVSRLKTPVXXAKSAK

SEQ ID NO: 1015 - protein, 20 aa, Artificial Sequence
  GFR-binding peptide
  MOD_RES (14)..(15): Xaa is C or S
VKAVKVSRMKTPTXXPGASG

SEQ ID NO: 1016 - protein, 20 aa, Artificial Sequence
  GFR-binding peptide
  MOD_RES (14)..(15): Xaa is C or S
VKAVKVSRLRAPVXXSAPAA

SEQ ID NO: 1017 - protein, 20 aa, Artificial Sequence
  GFR-binding peptide
  MOD_RES (14)..(15): Xaa is C or S
VKAVKVSRLRTPVXXTPPTS

SEQ ID NO: 1018 - protein, 20 aa, Artificial Sequence
  GFR-binding peptide
  MOD_RES (14)..(15): Xaa is C or S
VKAVKVSRLKTPAXXPKPVH

SEQ ID NO: 1019 - protein, 20 aa, Artificial Sequence
  GFR-binding peptide
  MOD_RES (14)..(15): Xaa is C or S
VKAVKVSRTKVPAXXTSPVR

SEQ ID NO: 1020 - protein, 20 aa, Artificial Sequence
  GFR-binding peptide
  MOD_RES (14)..(15): Xaa is C or S
VKAVKVSRLDQSVXXPSASA

SEQ ID NO: 1021 - protein, 20 aa, Artificial Sequence
  GFR-binding peptide
  MOD_RES (14)..(14): Xaa is C or S
VKAVKVSRQGTPVXELGEDN

SEQ ID NO: 1022 - protein, 20 aa, Artificial Sequence
  GFR-binding peptide
  MOD_RES (16)..(16): Xaa is C or S
VKAVKVSRLQVQTPRXQVNR

SEQ ID NO: 1023 - protein, 20 aa, Artificial Sequence
  GFR-binding peptide
  MOD_RES (16)..(16): Xaa is C or S
IKRVQVPRHHVQTPQXKVSS

SEQ ID NO: 1024 - protein, 20 aa, Artificial Sequence
  GFR-binding peptide
  MOD_RES (14)..(15): Xaa is C or S
IKRVQVPRLETPVXXAKPIK

SEQ ID NO: 1025 - protein, 20 aa, Artificial Sequence
  GFR-binding peptide
  MOD_RES (14)..(15): Xaa is C or S
IKRVQVPRMKEPVXXPEPIG

SEQ ID NO: 1026 - protein, 20 aa, Artificial Sequence
  GFR-binding peptide
  MOD_RES (14)..(15): Xaa is C or S
IKRVQVPRLETPVXXAKPIS

SEQ ID NO: 1027 - protein, 20 aa, Artificial Sequence
  GFR-binding peptide
  MOD_RES (14)..(14): Xaa is C or S
IKRVQVPRLKTPAXTPKTVH

SEQ ID NO: 1028 - protein, 20 aa, Artificial Sequence
  GFR-binding peptide
  MOD_RES (14)..(15): Xaa is C or S
IKRVQVPRLKTPAXXPKPVY

SEQ ID NO: 1029 - protein, 20 aa, Artificial Sequence
  GFR-binding peptide
  MOD_RES (14)..(15): Xaa is C or S
IKRVQVPRLQTPAXXPKPVT

SEQ ID NO: 1030 - protein, 20 aa, Artificial Sequence
  GFR-binding peptide
  MOD_RES (14)..(15): Xaa is C or S
IKRVQVPRLKTPAXXAKPVA

SEQ ID NO: 1031 - protein, 20 aa, Artificial Sequence
  GFR-binding peptide
  MOD_RES (14)..(15): Xaa is C or S
IKRVQVPRLKTPVXXAKGVK

SEQ ID NO: 1032 - protein, 20 aa, Artificial Sequence
  GFR-binding peptide
  MOD_RES (14)..(15): Xaa is C or S
IKRVQVPRLKTPVXXAKSAK

SEQ ID NO: 1033 - protein, 20 aa, Artificial Sequence
  GFR-binding peptide
  MOD_RES (14)..(15): Xaa is C or S
IKRVQVPRMKTPTXXPGASG

SEQ ID NO: 1034 - protein, 20 aa, Artificial Sequence
  GFR-binding peptide
  MOD_RES (14)..(15): Xaa is C or S
IKRVQVPRLRAPVXXSAPAA

SEQ ID NO: 1035 - protein, 20 aa, Artificial Sequence
  GFR-binding peptide
  MOD_RES (14)..(15): Xaa is C or S
IKRVQVPRLRTPVXXTPPTS

SEQ ID NO: 1036 - protein, 20 aa, Artificial Sequence
  GFR-binding peptide
  MOD_RES (14)..(15): Xaa is C or S
IKRVQVPRLKTPAXXPKPVH

SEQ ID NO: 1037 - protein, 20 aa, Artificial Sequence
  GFR-binding peptide
  MOD_RES (14)..(15): Xaa is C or S
IKRVQVPRTKVPAXXTSPVR

SEQ ID NO: 1038 - protein, 20 aa, Artificial Sequence
  GFR-binding peptide
  MOD_RES (14)..(15): Xaa is C or S
IKRVQVPRLDQSVXXPSASA

SEQ ID NO: 1039 - protein, 20 aa, Artificial Sequence
  GFR-binding peptide
  MOD_RES (14)..(14): Xaa is C or S
IKRVQVPRQGTPVXELGEDN

SEQ ID NO: 1040 - protein, 20 aa, Artificial Sequence
  GFR-binding peptide
  MOD_RES (16)..(16): Xaa is C or S
IKRVQVPRHHVRSPQXKVSS

SEQ ID NO: 1041 - protein, 8 aa, Artificial Sequence
  GFR-binding peptide
LYLISIAS

SEQ ID NO: 1042 - protein, 8 aa, Artificial Sequence
  GFR-binding peptide
LYLVSIAS

SEQ ID NO: 1043 - protein, 8 aa, Artificial Sequence
  GFR-binding peptide
FFLMSLSS

SEQ ID NO: 1044 - protein, 8 aa, Artificial Sequence
  GFR-binding peptide
FFLVSLSS

SEQ ID NO: 1045 - protein, 8 aa, Artificial Sequence
  GFR-binding peptide
FYLMSIAN

SEQ ID NO: 1046 - protein, 8 aa, Artificial Sequence
  GFR-binding peptide
FYLISIAN

SEQ ID NO: 1047 - protein, 8 aa, Artificial Sequence
  GFR-binding peptide
YYLMSTAS

SEQ ID NO: 1048 - protein, 8 aa, Artificial Sequence
  GFR-binding peptide
YYLISTAS

SEQ ID NO: 1049 - protein, 8 aa, Artificial Sequence
  GFR-binding peptide
KYLMSIPS

SEQ ID NO: 1050 - protein, 8 aa, Artificial Sequence
  GFR-binding peptide
KYLISIPS

SEQ ID NO: 1051 - protein, 8 aa, Artificial Sequence
  GFR-binding peptide
LYLMSIPE

SEQ ID NO: 1052 - protein, 8 aa, Artificial Sequence
  GFR-binding peptide
LYLVSIPE

SEQ ID NO: 1053 - protein, 8 aa, Artificial Sequence
  GFR-binding peptide
FYLINIPS

SEQ ID NO: 1054 - protein, 8 aa, Artificial Sequence
  GFR-binding peptide
FYLVNIPS

SEQ ID NO: 1055 - protein, 8 aa, Artificial Sequence
  GFR-binding peptide
IYLMSIPS

SEQ ID NO: 1056 - protein, 8 aa, Artificial Sequence
  GFR-binding peptide
IYLVSIPS

SEQ ID NO: 1057 - protein, 8 aa, Artificial Sequence
  GFR-binding peptide
IFLMSIPS

SEQ ID NO: 1058 - protein, 8 aa, Artificial Sequence
  GFR-binding peptide
IFLVSIPS

SEQ ID NO: 1059 - protein, 8 aa, Artificial Sequence
  GFR-binding peptide
VYLISLPK

SEQ ID NO: 1060 - protein, 8 aa, Artificial Sequence
  GFR-binding peptide
VYLVSLPK

SEQ ID NO: 1061 - protein, 8 aa, Artificial Sequence
  GFR-binding peptide
YYVMPLPE

SEQ ID NO: 1062 - protein, 8 aa, Artificial Sequence
  GFR-binding peptide
YYVVPLPE

SEQ ID NO: 1063 - protein, 8 aa, Artificial Sequence
  GFR-binding peptide
YYLMTLPE

SEQ ID NO: 1064 - protein, 8 aa, Artificial Sequence
  GFR-binding peptide
YYLVTLPE

SEQ ID NO: 1065 - protein, 8 aa, Artificial Sequence
  GFR-binding peptide
MIQITINS

SEQ ID NO: 1066 - protein, 8 aa, Artificial Sequence
  GFR-binding peptide
MIQVTINS

SEQ ID NO: 1067 - protein, 8 aa, Artificial Sequence
  GFR-binding peptide
VKAMKVSR

SEQ ID NO: 1068 - protein, 8 aa, Artificial Sequence
  GFR-binding peptide
VKAIKVSR

SEQ ID NO: 1069 - protein, 8 aa, Artificial Sequence
  GFR-binding peptide
IKRMQVPR

SEQ ID NO: 1070 - protein, 8 aa, Artificial Sequence
  GFR-binding peptide
IKRIQVPR

SEQ ID NO: 1071 - protein, 20 aa, Artificial Sequence
  GFR-binding peptide
RVPSTSSVPTELSAISVLYL

SEQ ID NO: 1072 - protein, 20 aa, Artificial Sequence
  GFR-binding peptide
RVPSTSSVPTDLSSLSILFF

SEQ ID NO: 1073 - protein, 20 aa, Artificial Sequence
  GFR-binding peptide
AASKASSVPQQLSSLSTLFF

SEQ ID NO: 1074 - protein, 20 aa, Artificial Sequence
  GFR-binding peptide
RVPSTSSVPQQLNAISTLYF

SEQ ID NO: 1075 - protein, 20 aa, Artificial Sequence
  GFR-binding peptide
AASKASSSRVEESATSTLYY

SEQ ID NO: 1076 - protein, 20 aa, Artificial Sequence
  GFR-binding peptide
RVPSTSSAPVEESPISTLYI

SEQ ID NO: 1077 - protein, 20 aa, Artificial Sequence
  GFR-binding peptide
RVPSTSSTQVRLSPISMLFI

SEQ ID NO: 1078 - protein, 20 aa, Artificial Sequence
  GFR-binding peptide
AASKASSVPTKMEPISTLYL

SEQ ID NO: 1079 - protein, 20 aa, Artificial Sequence
  GFR-binding peptide
AASKASSAPTKMSPINILYF

SEQ ID NO: 1080 - protein, 20 aa, Artificial Sequence
  GFR-binding peptide
RVPSTSSTPTKMKPLSILYV

SEQ ID NO: 1081 - protein, 20 aa, Artificial Sequence
  GFR-binding peptide
KIPKASSVPEELEPLPTVYY

SEQ ID NO: 1082 - protein, 20 aa, Artificial Sequence
  GFR-binding peptide
KIPKASSTPTGQSNITMQIM

SEQ ID NO: 1083 - protein, 20 aa, Artificial Sequence
  GFR-binding peptide
KIPKASSTPTRLRSVKMAKV

SEQ ID NO: 1084 - protein, 20 aa, Artificial Sequence
  GFR-binding peptide
KIPKASSVPTKMRPVQMRKI

SEQ ID NO: 1085 - protein, 20 aa, Artificial Sequence
  GFR-binding peptide
AASKASSVPAKMRPVQTRKI

SEQ ID NO: 1086 - protein, 10 aa, Artificial Sequence
  Previously reported sequence
VEQLSNMVVK

SEQ ID NO: 1087 - protein, 22 aa, Artificial Sequence
  Previously reported sequence
PIIYYVGRNVRVEQLSNMVVRA

SEQ ID NO: 1088 - protein, 23 aa, Artificial Sequence
  Previously reported sequence
PIIYYVGRNVRVEQLSNMVVRRA

SEQ ID NO: 1089 - protein, 29 aa, Artificial Sequence
  Previously reported sequence
DPLPIIYYVGRNVRVEQLSNMVVRACKCS

SEQ ID NO: 1090 - protein, 19 aa, Artificial Sequence
  Previously reported sequence
ENVNLKKYRNMIVKSCGCH

SEQ ID NO: 1091 - protein, 15 aa, Artificial Sequence
  Previously reported sequence
TPTYSRPVQKAELTR

SEQ ID NO: 1092 - protein, 29 aa, Artificial Sequence
  Previously reported sequence
HIRSTTSSYVSLKSNITNRTIQTPTYSYT

SEQ ID NO: 1093 - protein, 38 aa, Artificial Sequence
  Previously reported sequence
LMDLARMPSCLRGERAVPQDTTGYFTWSSNITPLNFIF

SEQ ID NO: 1094 - protein, 19 aa, Artificial Sequence
  Previously reported sequence
NEVLRFCGIQVPEGDEPLT

SEQ ID NO: 1095 - protein, 21 aa, Artificial Sequence
  Previously reported sequence
LNEVLRFCGIQVPEGDEPLTY

SEQ ID NO: 1096 - protein, 25 aa, Artificial Sequence
  Previously reported sequence
MSRVLFEPLTFLQTGSGLPDEKTLG

SEQ ID NO: 1097 - protein, 17 aa, Artificial Sequence
  Previously reported sequence
IKSPARHSAPTHQEPLP

SEQ ID NO: 1098 - protein, 21 aa, Artificial Sequence
  Previously reported sequence
NPGASASPCCVSQDLEPLPIL

SEQ ID NO: 1099 - protein, 26 aa, Artificial Sequence
  Previously reported sequence
SHQSAGDSIKSPARHSAPTHQEPLPD

SEQ ID NO: 1100 - protein, 16 aa, Artificial Sequence
  Previously reported sequence
PNYSVPAGNKPLSERE

SEQ ID NO: 1101 - protein, 23 aa, Artificial Sequence
  Previously reported sequence
TKPLSSLLFPNWNTTTTPTPPRP

SEQ ID NO: 1102 - protein, 23 aa, Artificial Sequence
  Previously reported sequence
CVTKPLSSLLFPNWNTTTTPTPP

SEQ ID NO: 1103 - protein, 21 aa, Artificial Sequence
  Previously reported sequence
VGAAWWLREQGSPINTLAVPA

SEQ ID NO: 1104 - protein, 38 aa, Artificial Sequence
  Previously reported sequence
MQCRELVTQVTEEPISQTEDGEEQESTTTPRLKGQKKE

SEQ ID NO: 1105 - protein, 36 aa, Artificial Sequence
  Previously reported sequence
VPTKLEPISVLYKDDMGVPTLKYHYEGMAVSECGCR

SEQ ID NO: 1106 - protein, 36 aa, Artificial Sequence
  Previously reported sequence
SPISILVVPELDASLPEKRPSLDGFEALLVYNAPKA

SEQ ID NO: 1107 - protein, 37 aa, Artificial Sequence
  Previously reported sequence
  misc_feature (3)..(3): Xaa can be any naturally occurring amino acid
  misc_feature (9)..(9): Xaa can be any naturally occurring amino acid
  misc_feature (18)..(18): Xaa can be any naturally occurring amino acid
TLXPIVSSXNPSPISFRXIKILLHDLEVVPFPKSRVR

SEQ ID NO: 1108 - protein, 35 aa, Artificial Sequence
  Previously reported sequence
VPTKLSPISILYLDKGVVTYKFKYEGMSVAECGCR

SEQ ID NO: 1109 - protein, 36 aa, Artificial Sequence
  Previously reported sequence
VPTKLSPISILYKDDMGVPTYKFKYEGMSVAECGCR

SEQ ID NO: 1110 - protein, 31 aa, Artificial Sequence
  Previously reported sequence
VPTELSPISLLYLDEFEKVTLKNYQDMVVDG

SEQ ID NO: 1111 - protein, 10 aa, Artificial Sequence
  Previously reported sequence
TPTVVSATSL

SEQ ID NO: 1112 - protein, 17 aa, Artificial Sequence
  Previously reported sequence
SATSRLALSDVPAELAA

SEQ ID NO: 1113 - protein, 23 aa, Artificial Sequence
  Previously reported sequence
LGIAAIIFLQQVPAAFSATSPPG

SEQ ID NO: 1114 - protein, 33 aa, Artificial Sequence
  Previously reported sequence
SVPAVCSATSATGPYSSVTVTSWPSIVATGGTT

SEQ ID NO: 1115 - protein, 33 aa, Artificial Sequence
  Previously reported sequence
SVPAVCSATSATGPYSTATNTVWPSIVATGGTT

SEQ ID NO: 1116 - protein, 33 aa, Artificial Sequence
  Previously reported sequence
SSVPAVCSATSATGPYSSGSVEVTFDVYATTVY

SEQ ID NO: 1117 - protein, 33 aa, Artificial Sequence
  Previously reported sequence
SSVPAVCSATSATGPYSTATNTVWFDVYATTVY

SEQ ID NO: 1118 - protein, 49 aa, Artificial Sequence
  Previously reported sequence
VHLLKPHAVPKACCAPTKLSATSVLYYDSSNNVILRKHRNMVVRACGCH

SEQ ID NO: 1119 - protein, 23 aa, Artificial Sequence
  Previously reported sequence
ANINKDRDNVPAATSSLSKAYNP

SEQ ID NO: 1120 - protein, 29 aa, Artificial Sequence
  Previously reported sequence
SFRTARANAPTGRSSLSGEKEQQEASTHS

SEQ ID NO: 1121 - protein, 48 aa, Artificial Sequence
  Previously reported sequence
DKPEESSSTPTHAQCICSSLSEAIVSSVLSTRLVLSQISLTRAKRAFE

SEQ ID NO: 1122 - protein, 50 aa, Artificial Sequence
  Previously reported sequence
  misc_feature (35)..(35): Xaa can be any naturally occurring amino acid
  misc_feature (38)..(38): Xaa can be any naturally occurring amino acid
KGSEYEKLVVSGITQVYQSSLSWHGCKSCCEVQVXNLXILIRLYDVHYYN

SEQ ID NO: 1123 - protein, 50 aa, Artificial Sequence
  Previously reported sequence
MALPQPRGSSLSKAPVVVAPCMALKRVNIRSIVFEVLKTMNQNCIHETPN

SEQ ID NO: 1124 - protein, 36 aa, Artificial Sequence
  Previously reported sequence
MAAQDEWRDAITLTMGRDLKKVPQHLNAISVIDPVT

SEQ ID NO: 1125 - protein, 42 aa, Artificial Sequence
  Previously reported sequence
LSLLAPPEPVWNHETSYGSDCHVPTNVNAISKMIDKSNHQTG

SEQ ID NO: 1126 - protein, 31 aa, Artificial Sequence
  Previously reported sequence
APTKLNAISVLYFDDSSNVILKKYRNMIVKS

SEQ ID NO: 1127 - protein, 11 aa, Artificial Sequence
  Previously reported sequence
APTQLSAISVL

SEQ ID NO: 1128 - protein, 18 aa, Artificial Sequence
  Previously reported sequence
FDSRVLKSAISFKENIIF

SEQ ID NO: 1129 - protein, 18 aa, Artificial Sequence
  Previously reported sequence
KIPKPSSAPTELSAISMC

SEQ ID NO: 1130 - protein, 18 aa, Artificial Sequence
  Previously reported sequence
CPKPSSAPTELSAISMLL

SEQ ID NO: 1131 - protein, 18 aa, Artificial Sequence
  Previously reported sequence
TCCVPELSAISMLYLDEN

SEQ ID NO: 1132 - protein, 19 aa, Artificial Sequence
  Previously reported sequence
KIPKPSSAPTELSAISMLC

SEQ ID NO: 1133 - protein, 20 aa, Artificial Sequence
  Previously reported sequence
KIPKPSSAPTELSAISMLYC

SEQ ID NO: 1134 - protein, 20 aa, Artificial Sequence
  Previously reported sequence
CIPKPSSAPTELSAISMLYL

SEQ ID NO: 1135 - protein, 21 aa, Artificial Sequence
  Previously reported sequence
CKIPKPSSAPTELSAISMLYL

SEQ ID NO: 1136 - protein, 22 aa, Artificial Sequence
  Previously reported sequence
AETLHTLGLSAPVIESAISDAI

SEQ ID NO: 1137 - protein, 33 aa, Artificial Sequence
  Previously reported sequence
MRTESTPTTASAISYECLWSPPSNEAAKLHFDS

SEQ ID NO: 1138 - protein, 47 aa, Artificial Sequence
  Previously reported sequence
SRVLPIVVQGYVPVQDTKFLGIYYVIGPIIARVILSSSSAISSLNKS

SEQ ID NO: 1139 - protein, 37 aa, Artificial Sequence
  Previously reported sequence
CCAPTELSAISVLYFDDSSNVILKKYRNMVVRACGCR

SEQ ID NO: 1140 - protein, 37 aa, Artificial Sequence
  Previously reported sequence
CCAPTQLSAISVLYFDDSSNVILKKYRNMVVRACGCR

SEQ ID NO: 1141 - protein, 39 aa, Artificial Sequence
  Previously reported sequence
KPCCAPTQLSAISVLYFDDSSNVILKKYRNMVVRACGCR

SEQ ID NO: 1142 - protein, 39 aa, Artificial Sequence
  Previously reported sequence
KPCCAPTELSAISVLYFDDSSNVILKKYRNMVVRACGCR

SEQ ID NO: 1143 - protein, 20 aa, Artificial Sequence
  GFR-binding peptide
NDEGLESVPEDLSSLSVLFF

SEQ ID NO: 1144 - protein, 20 aa, Artificial Sequence
  GFR-binding peptide
RVPSTSSVPTGQSAISTLYL

SEQ ID NO: 1145 - protein, 20 aa, Artificial Sequence
  GFR-binding peptide
RVPSTSSAPTKMNAISMLYF

SEQ ID NO: 1146 - protein, 20 aa, Artificial Sequence
  GFR-binding peptide
GIPEPSSAPTELSATSILYY

SEQ ID NO: 1147 - protein, 20 aa, Artificial Sequence
  GFR-binding peptide
STPPTSSVPTELSPISTLYK

SEQ ID NO: 1148 - protein, 20 aa, Artificial Sequence
  GFR-binding peptide
GIPEPSSAPVDLKPLSTLYV

SEQ ID NO: 1149 - protein, 20 aa, Artificial Sequence
  GFR-binding peptide
AASKASSVPQEEEPLPMVYY

SEQ ID NO: 1150 - protein, 20 aa, Artificial Sequence
  GFR-binding peptide
KIPKASSVSQKMEPLTMLYY

SEQ ID NO: 1151 - protein, 20 aa, Artificial Sequence
  GFR-binding peptide
KIPKASSVPTGGSNITVQIM

SEQ ID NO: 1152 - protein, 20 aa, Artificial Sequence
  GFR-binding peptide
AASKASSSRVELRSVKIAKV

SEQ ID NO: 1153 - protein, 20 aa, Artificial Sequence
  GFR-binding peptide
KIPKASSTQVRLRPVQIRKI

SEQ ID NO: 1154 - protein, 20 aa, Artificial Sequence
  GFR-binding peptide
STPPTSSSRVQLSAISMLYL

SEQ ID NO: 1155 - protein, 20 aa, Artificial Sequence
  GFR-binding peptide
RVPSTSSTQVKMSAISMLYL

SEQ ID NO: 1156 - protein, 20 aa, Artificial Sequence
  GFR-binding peptide
GIPEPSSVSQEESSLSTLFF

SEQ ID NO: 1157 - protein, 20 aa, Artificial Sequence
  GFR-binding peptide
KIPKASSSRVRLSSLSTLFF

SEQ ID NO: 1158 - protein, 20 aa, Artificial Sequence
  GFR-binding peptide
AASKASSTPTDLNAISTLYF

SEQ ID NO: 1159 - protein, 20 aa, Artificial Sequence
  GFR-binding peptide
RVPSTSSTQVDLNAISVLYF

SEQ ID NO: 1160 - protein, 20 aa, Artificial Sequence
  GFR-binding peptide
GIPEPSSVSQELSATSMLYY

SEQ ID NO: 1161 - protein, 20 aa, Artificial Sequence
  GFR-binding peptide
KIPKASSTQVGQSATSILYY

SEQ ID NO: 1162 - protein, 20 aa, Artificial Sequence
  GFR-binding peptide
STPPTSSAPVGQSPISMLYI

SEQ ID NO: 1163 - protein, 20 aa, Artificial Sequence
  GFR-binding peptide
KIPKASSTPTRLSPISMLFI

SEQ ID NO: 1164 - protein, 20 aa, Artificial Sequence
  GFR-binding peptide
GIPEPSSAPTRLEPISMLYL

SEQ ID NO: 1165 - protein, 20 aa, Artificial Sequence
  GFR-binding peptide
KIPKASSVSQQLEPISTLYL

SEQ ID NO: 1166 - protein, 20 aa, Artificial Sequence
  GFR-binding peptide
STPPTSSVPTEVSPINTLYF

SEQ ID NO: 1167 - protein, 20 aa, Artificial Sequence
  GFR-binding peptide
AASKASSSRVKMSPINVLYF

SEQ ID NO: 1168 - protein, 20 aa, Artificial Sequence
  GFR-binding peptide
KIPKASSVPTKMKPLSVLYV

SEQ ID NO: 1169 - protein, 20 aa, Artificial Sequence
  GFR-binding peptide
RVPSTSSAPTKMKPLSMLYV

SEQ ID NO: 1170 - protein, 20 aa, Artificial Sequence
  GFR-binding peptide
STPPTSSVSQKMKPLSILYV

SEQ ID NO: 1171 - protein, 20 aa, Artificial Sequence
  GFR-binding peptide
KIPKASSVPAQLEPLPIVYY

SEQ ID NO: 1172 - protein, 20 aa, Artificial Sequence
  GFR-binding peptide
GIPEPSSAPVGQEPLPMVYY

SEQ ID NO: 1173 - protein, 20 aa, Artificial Sequence
  GFR-binding peptide
RVPSTSSVPEKMEPLTMLYY

SEQ ID NO: 1174 - protein, 20 aa, Artificial Sequence
  GFR-binding peptide
GIPEPSSAPVEEEPLTTLYY

SEQ ID NO: 1175 - protein, 20 aa, Artificial Sequence
  GFR-binding peptide
STPPTSSTPTKMSNITTQIM

SEQ ID NO: 1176 - protein, 20 aa, Artificial Sequence
  GFR-binding peptide
RVPSTSSVPAEESNITVQIM

SEQ ID NO: 1177 - protein, 20 aa, Artificial Sequence
  GFR-binding peptide
AASKASSVPQRLRSVKVAKV

SEQ ID NO: 1178 - protein, 20 aa, Artificial Sequence
  GFR-binding peptide
KIPKASSTQVRLRSVKTAKV

SEQ ID NO: 1179 - protein, 20 aa, Artificial Sequence
  GFR-binding peptide
AASKASSVPEKMRPVQTRKI

SEQ ID NO: 1180 - protein, 20 aa, Artificial Sequence
  GFR-binding peptide
GIPEPSSAPVDMRPVQIRKI

SEQ ID NO: 1181 - protein, 20 aa, Artificial Sequence
  GFR-binding peptide
CSAAPSSVPTALSAISMLYL

SEQ ID NO: 1182 - protein, 13 aa, Artificial Sequence
  GFR-binding peptide
APTQLSAISVLYL

SEQ ID NO: 1183 - protein, 18 aa, Artificial Sequence
  GFR-binding peptide
  MOD_RES (4)..(5): Xaa is C or S
PKAXXVPTELSPISMLYK

SEQ ID NO: 1184 - protein, 10 aa, Artificial Sequence
  GFR-binding peptide
ALSATSILYY

SEQ ID NO: 1185 - protein, 10 aa, Artificial Sequence
  GFR-binding peptide
ELSPISMLYK

SEQ ID NO: 1186 - protein, 18 aa, Artificial Sequence
  GFR-binding peptide
  MOD_RES (4)..(5): Xaa is C or S
ASPXXVSQDLSPISILYK

SEQ ID NO: 1187 - protein, 19 aa, Artificial Sequence
  GFR-binding peptide
  MOD_RES (5)..(6): Xaa is C or S
SASPXXVSQDLSATSILYY

SEQ ID NO: 1188 - protein, 19 aa, Artificial Sequence
  GFR-binding peptide
  MOD_RES (5)..(6): Xaa is C or S
SASPXXVSQDLSAISILYL

SEQ ID NO: 1189 - protein, 11 aa, Artificial Sequence
  GFR-binding peptide
QDLNAISILYF

SEQ ID NO: 1190 - protein, 13 aa, Artificial Sequence
  GFR-binding peptide
VPQALSAISILYL

SEQ ID NO: 1191 - protein, 10 aa, Artificial Sequence
  GFR-binding peptide
ALSAISILYL

SEQ ID NO: 1192 - protein, 16 aa, Artificial Sequence
  GFR-binding peptide
  MOD_RES (2)..(3): Xaa is C or S
PXXAPTQLSATSVLYY

SEQ ID NO: 1193 - protein, 16 aa, Artificial Sequence
  GFR-binding peptide
  MOD_RES (2)..(3): Xaa is C or S
PXXVPQALSATSILYY

SEQ ID NO: 1194 - protein, 12 aa, Artificial Sequence
  GFR-binding peptide
PQALSPISILYK

SEQ ID NO: 1195 - protein, 13 aa, Artificial Sequence
  GFR-binding peptide
VSQDLSATSILYY

SEQ ID NO: 1196 - protein, 10 aa, Artificial Sequence
  GFR-binding peptide
ELNAISMLYF

SEQ ID NO: 1197 - protein, 18 aa, Artificial Sequence
  GFR-binding peptide
  MOD_RES (4)..(5): Xaa is C or S
ASPXXVPQDLSATSILYY

SEQ ID NO: 1198 - protein, 18 aa, Artificial Sequence
  GFR-binding peptide
  MOD_RES (4)..(5): Xaa is C or S
AAPXXVPQALSATSILYY

SEQ ID NO: 1199 - protein, 12 aa, Artificial Sequence
  GFR-binding peptide
SQDLSAISILYL

SEQ ID NO: 1200 - protein, 18 aa, Artificial Sequence
  GFR-binding peptide
  MOD_RES (4)..(5): Xaa is C or S
PKAXXAPTKLNAISVLYF

SEQ ID NO: 1201 - protein, 17 aa, Artificial Sequence
  GFR-binding peptide
  MOD_RES (2)..(2): Xaa is C or S
QXRPTQVQLSPISVLYK

SEQ ID NO: 1202 - protein, 18 aa, Artificial Sequence
  GFR-binding peptide
  MOD_RES (3)..(3): Xaa is C or S
VQXRPTQVQLSAISVLYL

SEQ ID NO: 1203 - protein, 16 aa, Artificial Sequence
  GFR-binding peptide
  MOD_RES (2)..(3): Xaa is C or S
PXXVPQALSAISILYL

SEQ ID NO: 1204 - protein, 12 aa, Artificial Sequence
  GFR-binding peptide
PTQLSPISVLYK

SEQ ID NO: 1205 - protein, 16 aa, Artificial Sequence
  GFR-binding peptide
  MOD_RES (2)..(3): Xaa is C or S
PXXAPTQLSAISVLYL

SEQ ID NO: 1206 - protein, 17 aa, Artificial Sequence
  GFR-binding peptide
  MOD_RES (2)..(2): Xaa is C or S
QXRPTQVQLSAISVLYL

SEQ ID NO: 1207 - protein, 19 aa, Artificial Sequence
  GFR-binding peptide
  MOD_RES (5)..(6): Xaa is C or S
VPKPXXAPTQLSATSVLYY

SEQ ID NO: 1208 - protein, 13 aa, Artificial Sequence
  GFR-binding peptide
VSQDLSAISILYL

SEQ ID NO: 1209 - protein, 14 aa, Artificial Sequence
  GFR-binding peptide
PTQVQLNAISVLYF

SEQ ID NO: 1210 - protein, 17 aa, Artificial Sequence
  GFR-binding peptide
  MOD_RES (3)..(4): Xaa is C or S
SPXXVPQDLNAISILYF

SEQ ID NO: 1211 - protein, 16 aa, Artificial Sequence
  GFR-binding peptide
  MOD_RES (2)..(3): Xaa is C or S
AXXAPTKLSAISVLYL

SEQ ID NO: 1212 - protein, 18 aa, Artificial Sequence
  GFR-binding peptide
  MOD_RES (4)..(5): Xaa is C or S
ASPXXVPQDLSAISILYL

SEQ ID NO: 1213 - protein, 15 aa, Artificial Sequence
  GFR-binding peptide
  MOD_RES (1)..(2): Xaa is C or S
XXVPQALSAISILYL

SEQ ID NO: 1214 - protein, 18 aa, Artificial Sequence
  GFR-binding peptide
  MOD_RES (4)..(5): Xaa is C or S
GKAXXVPTKLSAISVLYL

SEQ ID NO: 1215 - protein, 11 aa, Artificial Sequence
  GFR-binding peptide
QDLSPISILYK

SEQ ID NO: 1216 - protein, 18 aa, Artificial Sequence
  GFR-binding peptide
  MOD_RES (3)..(3): Xaa is C or S
VQXRPTQVQLSATSVLYY

SEQ ID NO: 1217 - protein, 9 aa, Artificial Sequence
  GFR-binding peptide
LSATSMLYY

SEQ ID NO: 1218 - protein, 18 aa, Artificial Sequence
  GFR-binding peptide
  MOD_RES (4)..(5): Xaa is C or S
PKAXXVPTELNAISMLYF

SEQ ID NO: 1219 - protein, 13 aa, Artificial Sequence
  GFR-binding peptide
VPQALSATSILYY

SEQ ID NO: 1220 - protein, 15 aa, Artificial Sequence
  GFR-binding peptide
  MOD_RES (2)..(2): Xaa is C or S
TXAPTKLSATSVLYY

SEQ ID NO: 1221 - protein, 11 aa, Artificial Sequence
  GFR-binding peptide
TELSPISMLYK

SEQ ID NO: 1222 - protein, 17 aa, Artificial Sequence
  GFR-binding peptide
  MOD_RES (2)..(2): Xaa is C or S
QXRPTQVQLSATSVLYY

SEQ ID NO: 1223 - protein, 17 aa, Artificial Sequence
  GFR-binding peptide
  MOD_RES (3)..(4): Xaa is C or S
APXXVPQALSPISILYK

SEQ ID NO: 1224 - protein, 18 aa, Artificial Sequence
  GFR-binding peptide
  MOD_RES (4)..(5): Xaa is C or S
GKAXXVPTKLNAISVLYF

SEQ ID NO: 1225 - protein, 20 aa, Artificial Sequence
  GFR-binding peptide
  MOD_RES (6)..(7): Xaa is C or S
SIPKAXXVPTELSATSMLYY

SEQ ID NO: 1226 - protein, 15 aa, Artificial Sequence
  GFR-binding peptide
  MOD_RES (1)..(2): Xaa is C or S
XXVPQALSATSILYY

SEQ ID NO: 1227 - protein, 17 aa, Artificial Sequence
  GFR-binding peptide
  MOD_RES (3)..(4): Xaa is C or S
KAXXVPTELNAISMLYF

SEQ ID NO: 1228 - protein, 17 aa, Artificial Sequence
  GFR-binding peptide
  MOD_RES (3)..(4): Xaa is C or S
APXXVPQALNAISILYF

SEQ ID NO: 1229 - protein, 20 aa, Artificial Sequence
  GFR-binding peptide
  MOD_RES (6)..(7): Xaa is C or S
TVPKPXXAPTQLSAISVLYL

SEQ ID NO: 1230 - protein, 18 aa, Artificial Sequence
  GFR-binding peptide
  MOD_RES (4)..(5): Xaa is C or S
AAPXXVPQALSAISILYL

SEQ ID NO: 1231 - protein, 19 aa, Artificial Sequence
  GFR-binding peptide
  MOD_RES (5)..(6): Xaa is C or S
VPKPXXAPTQLSAISVLYL

SEQ ID NO: 1232 - protein, 11 aa, Artificial Sequence
  GFR-binding peptide
TELNAISMLYF

SEQ ID NO: 1233 - protein, 17 aa, Artificial Sequence
  GFR-binding peptide
  MOD_RES (3)..(4): Xaa is C or S
KAXXVPTELSPISMLYK

SEQ ID NO: 1234 - protein, 12 aa, Artificial Sequence
  GFR-binding peptide
SQDLSATSILYY

SEQ ID NO: 1235 - protein, 14 aa, Artificial Sequence
  GFR-binding peptide
  MOD_RES (1)..(1): Xaa is C or S
XVPQALSAISILYL

SEQ ID NO: 1236 - protein, 20 aa, Artificial Sequence
  GFR-binding peptide
  MOD_RES (7)..(7): Xaa is C or S
HVTKPTXAPTKLSAISVLYL

SEQ ID NO: 1237 - protein, 18 aa, Artificial Sequence
  GFR-binding peptide
  MOD_RES (4)..(5): Xaa is C or S
ASPXXVPQDLSPISILYK

SEQ ID NO: 1238 - protein, 13 aa, Artificial Sequence
  GFR-binding peptide
APTKLSAISVLYL

SEQ ID NO: 1239 - protein, 19 aa, Artificial Sequence
  GFR-binding peptide
  MOD_RES (5)..(6): Xaa is C or S
SAAPXXVPQALSATSILYY

SEQ ID NO: 1240 - protein, 17 aa, Artificial Sequence
  GFR-binding peptide
  MOD_RES (3)..(4): Xaa is C or S
KAXXAPTKLNAISVLYF

SEQ ID NO: 1241 - protein, 17 aa, Artificial Sequence
  GFR-binding peptide
  MOD_RES (3)..(4): Xaa is C or S
SPXXVPQDLSPISILYK

SEQ ID NO: 1242 - protein, 19 aa, Artificial Sequence
  GFR-binding peptide
  MOD_RES (5)..(6): Xaa is C or S
SASPXXVPQDLSATSILYY

SEQ ID NO: 1243 - protein, 16 aa, Artificial Sequence
  GFR-binding peptide
  MOD_RES (1)..(1): Xaa is C or S
XRPTQVQLSAISVLYL

SEQ ID NO: 1244 - protein, 19 aa, Artificial Sequence
  GFR-binding peptide
  MOD_RES (5)..(6): Xaa is C or S
VPKAXXAPTKLSAISVLYL

SEQ ID NO: 1245 - protein, 16 aa, Artificial Sequence
  GFR-binding peptide
  MOD_RES (2)..(3): Xaa is C or S
PXXVPQALSPISILYK

SEQ ID NO: 1246 - protein, 20 aa, Artificial Sequence
  GFR-binding peptide
  MOD_RES (5)..(5): Xaa is C or S
RNVQXRPTQVQLNAISVLYF

SEQ ID NO: 1247 - protein, 16 aa, Artificial Sequence
  GFR-binding peptide
  MOD_RES (2)..(3): Xaa is C or S
PXXAPTKLSATSVLYY

SEQ ID NO: 1248 - protein, 19 aa, Artificial Sequence
  GFR-binding peptide
  MOD_RES (5)..(6): Xaa is C or S
SASPXXVPQDLSAISILYL

SEQ ID NO: 1249 - protein, 17 aa, Artificial Sequence
  GFR-binding peptide
  MOD_RES (3)..(4): Xaa is C or S
KAXXVPTKLNAISVLYF

SEQ ID NO: 1250 - protein, 15 aa, Artificial Sequence
  GFR-binding peptide
RPTQVQLNAISVLYF

SEQ ID NO: 1251 - protein, 19 aa, Artificial Sequence
  GFR-binding peptide
  MOD_RES (5)..(6): Xaa is C or S
SASPXXVSQDLSPISILYK

SEQ ID NO: 1252 - protein, 17 aa, Artificial Sequence
  GFR-binding peptide
  MOD_RES (4)..(4): Xaa is C or S
KPTXAPTKLSAISVLYL

SEQ ID NO: 1253 - protein, 15 aa, Artificial Sequence
  GFR-binding peptide
  MOD_RES (1)..(2): Xaa is C or S
XXVPQDLNAISILYF

SEQ ID NO: 1254 - protein, 14 aa, Artificial Sequence
  GFR-binding peptide
  MOD_RES (1)..(1): Xaa is C or S
XVPTELSPISMLYK

SEQ ID NO: 1255 - protein, 17 aa, Artificial Sequence
  GFR-binding peptide
  MOD_RES (3)..(4): Xaa is C or S
SPXXVSQDLSATSILYY

SEQ ID NO: 1256 - protein, 11 aa, Artificial Sequence
  GFR-binding peptide
TKLSAISVLYL

SEQ ID NO: 1257 - protein, 11 aa, Artificial Sequence
  GFR-binding peptide
QALSATSILYY

SEQ ID NO: 1258 - protein, 11 aa, Artificial Sequence
  GFR-binding peptide
QDLSATSILYY

SEQ ID NO: 1259 - protein, 12 aa, Artificial Sequence
  GFR-binding peptide
PTELSATSMLYY

SEQ ID NO: 1260 - protein, 20 aa, Artificial Sequence
  GFR-binding peptide
  MOD_RES (6)..(7): Xaa is C or S
KIPKAXXVPTELNAISMLYF

SEQ ID NO: 1261 - protein, 18 aa, Artificial Sequence
  GFR-binding peptide
  MOD_RES (3)..(3): Xaa is C or S
VQXRPTQVQLNAISVLYF

SEQ ID NO: 1262 - protein, 17 aa, Artificial Sequence
  GFR-binding peptide
  MOD_RES (3)..(4): Xaa is C or S
KPXXAPTKLSAISVLYL

SEQ ID NO: 1263 - protein, 18 aa, Artificial Sequence
  GFR-binding peptide
  MOD_RES (4)..(5): Xaa is C or S
PKAXXAPTKLSAISVLYL

SEQ ID NO: 1264 - protein, 12 aa, Artificial Sequence
  GFR-binding peptide
SQDLNAISILYF

SEQ ID NO: 1265 - protein, 11 aa, Artificial Sequence
  GFR-binding peptide
VQLNAISVLYF

SEQ ID NO: 1266 - protein, 10 aa, Artificial Sequence
  GFR-binding peptide
ALNAISILYF

SEQ ID NO: 1267 - protein, 15 aa, Artificial Sequence
  GFR-binding peptide
  MOD_RES (1)..(2): Xaa is C or S
XXVPQALNAISILYF

SEQ ID NO: 1268 - protein, 13 aa, Artificial Sequence
  GFR-binding peptide
VPQDLSAISILYL

SEQ ID NO: 1269 - protein, 13 aa, Artificial Sequence
  GFR-binding peptide
VPQALNAISILYF

SEQ ID NO: 1270 - protein, 12 aa, Artificial Sequence
  GFR-binding peptide
PTELSPISMLYK

SEQ ID NO: 1271 - protein, 14 aa, Artificial Sequence
  GFR-binding peptide
  MOD_RES (1)..(1): Xaa is C or S
XVPTELSATSMLYY

SEQ ID NO: 1272 - protein, 14 aa, Artificial Sequence
  GFR-binding peptide
  MOD_RES (1)..(1): Xaa is C or S
XVPQDLSAISILYL

SEQ ID NO: 1273 - protein, 9 aa, Artificial Sequence
  GFR-binding peptide
LSPISMLYK

SEQ ID NO: 1274 - protein, 15 aa, Artificial Sequence
  GFR-binding peptide
  MOD_RES (2)..(2): Xaa is C or S
TXAPTKLSPISVLYK

SEQ ID NO: 1275 - protein, 18 aa, Artificial Sequence
  GFR-binding peptide
  MOD_RES (4)..(5): Xaa is C or S
PKPXXAPTKLSAISVLYL

SEQ ID NO: 1276 - protein, 14 aa, Artificial Sequence
  GFR-binding peptide
  MOD_RES (1)..(1): Xaa is C or S
XVSQDLNAISILYF

SEQ ID NO: 1277 - protein, 16 aa, Artificial Sequence
  GFR-binding peptide
  MOD_RES (2)..(3): Xaa is C or S
PXXVPQDLSATSILYY

SEQ ID NO: 1278 - protein, 18 aa, Artificial Sequence
  GFR-binding peptide
  MOD_RES (4)..(5): Xaa is C or S
GKAXXVPTKLSATSVLYY

SEQ ID NO: 1279 - protein, 15 aa, Artificial Sequence
  GFR-binding peptide
  MOD_RES (1)..(2): Xaa is C or S
XXVPTELSPISMLYK

SEQ ID NO: 1280 - protein, 14 aa, Artificial Sequence
  GFR-binding peptide
  MOD_RES (1)..(1): Xaa is C or S
XVPQDLNAISILYF

SEQ ID NO: 1281 - protein, 16 aa, Artificial Sequence
  GFR-binding peptide
  MOD_RES (2)..(3): Xaa is C or S
PXXVSQDLSATSILYY

SEQ ID NO: 1282 - protein, 13 aa, Artificial Sequence
  GFR-binding peptide
VPQDLNAISILYF

SEQ ID NO: 1283 - protein, 20 aa, Artificial Sequence
  GFR-binding peptide
  MOD_RES (6)..(7): Xaa is C or S
ASASPXXVPQDLSPISILYK

SEQ ID NO: 1284 - protein, 15 aa, Artificial Sequence
  GFR-binding peptide
  MOD_RES (1)..(2): Xaa is C or S
XXVSQDLSATSILYY

SEQ ID NO: 1285 - protein, 19 aa, Artificial Sequence
  GFR-binding peptide
  MOD_RES (5)..(6): Xaa is C or S
VGKAXXVPTKLNAISVLYF

SEQ ID NO: 1286 - protein, 15 aa, Artificial Sequence
  GFR-binding peptide
  MOD_RES (1)..(2): Xaa is C or S
XXAPTKLSAISVLYL

SEQ ID NO: 1287 - protein, 16 aa, Artificial Sequence
  GFR-binding peptide
  MOD_RES (2)..(3): Xaa is C or S
AXXVPTKLNAISVLYF

SEQ ID NO: 1288 - protein, 9 aa, Artificial Sequence
  GFR-binding peptide
LSAISILYL

SEQ ID NO: 1289 - protein, 16 aa, Artificial Sequence
  GFR-binding peptide
  MOD_RES (2)..(3): Xaa is C or S
PXXVSQDLSPISILYK

SEQ ID NO: 1290 - protein, 10 aa, Artificial Sequence
  GFR-binding peptide
DLNAISILYF

SEQ ID NO: 1291 - protein, 18 aa, Artificial Sequence
  GFR-binding peptide
  MOD_RES (4)..(5): Xaa is C or S
PKPXXAPTQLSAISVLYL

SEQ ID NO: 1292 - protein, 15 aa, Artificial Sequence
  GFR-binding peptide
  MOD_RES (1)..(2): Xaa is C or S
XXAPTQLSAISVLYL

SEQ ID NO: 1293 - protein, 20 aa, Artificial Sequence
  GFR-binding peptide
  MOD_RES (6)..(7): Xaa is C or S
ASAAPXXVPQALNAISILYF

SEQ ID NO: 1294 - protein, 13 aa, Artificial Sequence
  GFR-binding peptide
TQVQLSAISVLYL

SEQ ID NO: 1295 - protein, 19 aa, Artificial Sequence
  GFR-binding peptide
  MOD_RES (6)..(6): Xaa is C or S
VTKPTXAPTKLSAISVLYL

SEQ ID NO: 1296 - protein, 20 aa, Artificial Sequence
  GFR-binding peptide
  MOD_RES (6)..(7): Xaa is C or S
ASAAPXXVPQALSAISILYL

SEQ ID NO: 1297 - protein, 13 aa, Artificial Sequence
  GFR-binding peptide
TQVQLNAISVLYF

SEQ ID NO: 1298 - protein, 18 aa, Artificial Sequence
  GFR-binding peptide
  MOD_RES (4)..(5): Xaa is C or S
ASPXXVSQDLNAISILYF

SEQ ID NO: 1299 - protein, 12 aa, Artificial Sequence
  GFR-binding peptide
PQALSAISILYL

SEQ ID NO: 1300 - protein, 16 aa, Artificial Sequence
  GFR-binding peptide
  MOD_RES (2)..(3): Xaa is C or S
AXXVPTKLSAISVLYL

SEQ ID NO: 1301 - protein, 12 aa, Artificial Sequence
  GFR-binding peptide
PQALNAISILYF

SEQ ID NO: 1302 - protein, 12 aa, Artificial Sequence
  GFR-binding peptide
PQDLSAISILYL

SEQ ID NO: 1303 - protein, 19 aa, Artificial Sequence
  GFR-binding peptide
  MOD_RES (4)..(4): Xaa is C or S
NVQXRPTQVQLNAISVLYF

SEQ ID NO: 1304 - protein, 12 aa, Artificial Sequence
  GFR-binding peptide
PTQLSATSVLYY

SEQ ID NO: 1305 - protein, 10 aa, Artificial Sequence
  GFR-binding peptide
ELSATSMLYY

SEQ ID NO: 1306 - protein, 18 aa, Artificial Sequence
  GFR-binding peptide
  MOD_RES (5)..(5): Xaa is C or S
TKPTXAPTKLSAISVLYL

SEQ ID NO: 1307 - protein, 20 aa, Artificial Sequence
  GFR-binding peptide
  MOD_RES (5)..(5): Xaa is C or S
RNVQXRPTQVQLSAISVLYL

SEQ ID NO: 1308 - protein, 19 aa, Artificial Sequence
  GFR-binding peptide
  MOD_RES (5)..(6): Xaa is C or S
IPKAXXVPTELSATSMLYY

SEQ ID NO: 1309 - protein, 15 aa, Artificial Sequence
  GFR-binding peptide
RPTQVQLSAISVLYL

SEQ ID NO: 1310 - protein, 18 aa, Artificial Sequence
  GFR-binding peptide
  MOD_RES (4)..(5): Xaa is C or S
ASPXXVSQDLSAISILYL

SEQ ID NO: 1311 - protein, 17 aa, Artificial Sequence
  GFR-binding peptide
  MOD_RES (3)..(4): Xaa is C or S
KPXXAPTQLSAISVLYL

SEQ ID NO: 1312 - protein, 9 aa, Artificial Sequence
  GFR-binding peptide
LNAISILYF

SEQ ID NO: 1313 - protein, 17 aa, Artificial Sequence
  GFR-binding peptide
  MOD_RES (3)..(4): Xaa is C or S
KAXXVPTKLSATSVLYY

SEQ ID NO: 1314 - protein, 17 aa, Artificial Sequence
  GFR-binding peptide
  MOD_RES (3)..(4): Xaa is C or S
SPXXVSQDLSPISILYK

SEQ ID NO: 1315 - protein, 14 aa, Artificial Sequence
  GFR-binding peptide
  MOD_RES (1)..(1): Xaa is C or S
XVPQALNAISILYF

SEQ ID NO: 1316 - protein, 17 aa, Artificial Sequence
  GFR-binding peptide
  MOD_RES (3)..(4): Xaa is C or S
KAXXAPTKLSAISVLYL

SEQ ID NO: 1317 - protein, 10 aa, Artificial Sequence
  GFR-binding peptide
QLSAISVLYL

SEQ ID NO: 1318 - protein, 15 aa, Artificial Sequence
  GFR-binding peptide
  MOD_RES (1)..(2): Xaa is C or S
XXAPTKLSPISVLYK

SEQ ID NO: 1319 - protein, 11 aa, Artificial Sequence
  GFR-binding peptide
VQLSAISVLYL

SEQ ID NO: 1320 - protein, 12 aa, Artificial Sequence
  GFR-binding peptide
QVQLSAISVLYL

SEQ ID NO: 1321 - protein, 16 aa, Artificial Sequence
  GFR-binding peptide
  MOD_RES (2)..(3): Xaa is C or S
PXXAPTKLSPISVLYK

SEQ ID NO: 1322 - protein, 19 aa, Artificial Sequence
  GFR-binding peptide
  MOD_RES (5)..(6): Xaa is C or S
SAAPXXVPQALSPISILYK

SEQ ID NO: 1323 - protein, 19 aa, Artificial Sequence
  GFR-binding peptide
  MOD_RES (5)..(6): Xaa is C or S
SAAPXXVPQALNAISILYF

SEQ ID NO: 1324 - protein, 13 aa, Artificial Sequence
  GFR-binding peptide
VPQDLSPISILYK

SEQ ID NO: 1325 - protein, 19 aa, Artificial Sequence
  GFR-binding peptide
  MOD_RES (5)..(6): Xaa is C or S
IPKAXXVPTELSPISMLYK

SEQ ID NO: 1326 - protein, 10 aa, Artificial Sequence
  GFR-binding peptide
QLSATSVLYY

SEQ ID NO: 1327 - protein, 19 aa, Artificial Sequence
  GFR-binding peptide
  MOD_RES (4)..(4): Xaa is C or S
NVQXRPTQVQLSATSVLYY

SEQ ID NO: 1328 - protein, 14 aa, Artificial Sequence
  GFR-binding peptide
  MOD_RES (1)..(1): Xaa is C or S
XAPTQLSPISVLYK

SEQ ID NO: 1329 - protein, 12 aa, Artificial Sequence
  GFR-binding peptide
PTELNAISMLYF

SEQ ID NO: 1330 - protein, 17 aa, Artificial Sequence
  GFR-binding peptide
  MOD_RES (3)..(4): Xaa is C or S
SPXXVPQDLSATSILYY

SEQ ID NO: 1331 - protein, 12 aa, Artificial Sequence
  GFR-binding peptide
QVQLSATSVLYY

SEQ ID NO: 1332 - protein, 16 aa, Artificial Sequence
  GFR-binding peptide
  MOD_RES (2)..(3): Xaa is C or S
AXXVPTELSPISMLYK

SEQ ID NO: 1333 - protein, 19 aa, Artificial Sequence
  GFR-binding peptide
  MOD_RES (4)..(4): Xaa is C or S
NVQXRPTQVQLSAISVLYL

SEQ ID NO: 1334 - protein, 15 aa, Artificial Sequence
  GFR-binding peptide
RPTQVQLSATSVLYY

SEQ ID NO: 1335 - protein, 14 aa, Artificial Sequence
  GFR-binding peptide
PTQVQLSATSVLYY

SEQ ID NO: 1336 - protein, 9 aa, Artificial Sequence
  GFR-binding peptide
LSATSILYY

SEQ ID NO: 1337 - protein, 18 aa, Artificial Sequence
  GFR-binding peptide
  MOD_RES (5)..(5): Xaa is C or S
TKPTXAPTKLSATSVLYY

SEQ ID NO: 1338 - protein, 17 aa, Artificial Sequence
  GFR-binding peptide
  MOD_RES (3)..(4): Xaa is C or S
KAXXVPTELSATSMLYY

SEQ ID NO: 1339 - protein, 13 aa, Artificial Sequence
  GFR-binding peptide
VPTELSPISMLYK

SEQ ID NO: 1340 - protein, 16 aa, Artificial Sequence
  GFR-binding peptide
  MOD_RES (1)..(1): Xaa is C or S
XRPTQVQLSPISVLYK

SEQ ID NO: 1341 - protein, 13 aa, Artificial Sequence
  GFR-binding peptide
VPTKLNAISVLYF

SEQ ID NO: 1342 - protein, 14 aa, Artificial Sequence
  GFR-binding peptide
  MOD_RES (1)..(1): Xaa is C or S
XVSQDLSPISILYK

SEQ ID NO: 1343 - protein, 19 aa, Artificial Sequence
  GFR-binding peptide
  MOD_RES (5)..(6): Xaa is C or S
VPKAXXAPTKLNAISVLYF

SEQ ID NO: 1344 - protein, 12 aa, Artificial Sequence
  GFR-binding peptide
PQDLNAISILYF

SEQ ID NO: 1345 - protein, 14 aa, Artificial Sequence
  GFR-binding peptide
  MOD_RES (1)..(1): Xaa is C or S
XAPTKLSAISVLYL

SEQ ID NO: 1346 - protein, 16 aa, Artificial Sequence
  GFR-binding peptide
  MOD_RES (1)..(1): Xaa is C or S
XRPTQVQLNAISVLYF

SEQ ID NO: 1347 - protein, 19 aa, Artificial Sequence
  GFR-binding peptide
  MOD_RES (5)..(6): Xaa is C or S
VPKPXXAPTKLSAISVLYL

SEQ ID NO: 1348 - protein, 19 aa, Artificial Sequence
  GFR-binding peptide
  MOD_RES (5)..(6): Xaa is C or S
IPKAXXVPTELNAISMLYF

SEQ ID NO: 1349 - protein, 17 aa, Artificial Sequence
  GFR-binding peptide
  MOD_RES (3)..(4): Xaa is C or S
SPXXVPQDLSAISILYL

SEQ ID NO: 1350 - protein, 14 aa, Artificial Sequence
  GFR-binding peptide
  MOD_RES (1)..(1): Xaa is C or S
XVPTKLSATSVLYY

SEQ ID NO: 1351 - protein, 20 aa, Artificial Sequence
  GFR-binding peptide
  MOD_RES (6)..(7): Xaa is C or S
SIPKAXXVPTELSPISMLYK

SEQ ID NO: 1352 - protein, 19 aa, Artificial Sequence
  GFR-binding peptide
  MOD_RES (5)..(6): Xaa is C or S
SASPXXVPQDLNAISILYF

SEQ ID NO: 1353 - protein, 20 aa, Artificial Sequence
  GFR-binding peptide
  MOD_RES (6)..(7): Xaa is C or S
SIPKAXXVPTELNAISMLYF

SEQ ID NO: 1354 - protein, 19 aa, Artificial Sequence
  GFR-binding peptide
  MOD_RES (5)..(6): Xaa is C or S
VGKAXXVPTKLSAISVLYL

SEQ ID NO: 1355 - protein, 19 aa, Artificial Sequence
  GFR-binding peptide
  MOD_RES (5)..(6): Xaa is C or S
VPKAXXAPTKLSPISVLYK

SEQ ID NO: 1356 - protein, 16 aa, Artificial Sequence
  GFR-binding peptide
  MOD_RES (2)..(3): Xaa is C or S
AXXVPTELNAISMLYF

SEQ ID NO: 1357 - protein, 17 aa, Artificial Sequence
  GFR-binding peptide
  MOD_RES (3)..(4): Xaa is C or S
APXXVPQALSATSILYY

SEQ ID NO: 1358 - protein, 15 aa, Artificial Sequence
  GFR-binding peptide
  MOD_RES (1)..(2): Xaa is C or S
XXVPQDLSAISILYL

SEQ ID NO: 1359 - protein, 10 aa, Artificial Sequence
  GFR-binding peptide
DLSAISILYL

SEQ ID NO: 1360 - protein, 19 aa, Artificial Sequence
  GFR-binding peptide
  MOD_RES (5)..(6): Xaa is C or S
SASPXXVPQDLSPISILYK

SEQ ID NO: 1361 - protein, 17 aa, Artificial Sequence
  GFR-binding peptide
  MOD_RES (3)..(4): Xaa is C or S
KAXXVPTKLSAISVLYL

SEQ ID NO: 1362 - protein, 9 aa, Artificial Sequence
  GFR-binding peptide
LNAISMLYF

SEQ ID NO: 1363 - protein, 20 aa, Artificial Sequence
  GFR-binding peptide
  MOD_RES (6)..(7): Xaa is C or S
AVPKAXXAPTKLSAISVLYL

SEQ ID NO: 1364 - protein, 10 aa, Artificial Sequence
  GFR-binding peptide
DLSATSILYY

SEQ ID NO: 1365 - protein, 16 aa, Artificial Sequence
  GFR-binding peptide
  MOD_RES (2)..(3): Xaa is C or S
AXXAPTKLNAISVLYF

SEQ ID NO: 1366 - protein, 16 aa, Artificial Sequence
  GFR-binding peptide
  MOD_RES (3)..(3): Xaa is C or S
PTXAPTKLSATSVLYY

SEQ ID NO: 1367 - protein, 11 aa, Artificial Sequence
  GFR-binding peptide
TQLSATSVLYY

SEQ ID NO: 1368 - protein, 17 aa, Artificial Sequence
  GFR-binding peptide
  MOD_RES (3)..(4): Xaa is C or S
APXXVPQALSAISILYL

SEQ ID NO: 1369 - protein, 15 aa, Artificial Sequence
  GFR-binding peptide
  MOD_RES (1)..(2): Xaa is C or S
XXVPTKLSAISVLYL

SEQ ID NO: 1370 - protein, 16 aa, Artificial Sequence
  GFR-binding peptide
  MOD_RES (3)..(3): Xaa is C or S
PTXAPTKLSAISVLYL

SEQ ID NO: 1371 - protein, 14 aa, Artificial Sequence
  GFR-binding peptide
  MOD_RES (1)..(1): Xaa is C or S
XVSQDLSAISILYL

SEQ ID NO: 1372 - protein, 15 aa, Artificial Sequence
  GFR-binding peptide
  MOD_RES (1)..(2): Xaa is C or S
XXVPTKLNAISVLYF

SEQ ID NO: 1373 - protein, 19 aa, Artificial Sequence
  GFR-binding peptide
  MOD_RES (5)..(6): Xaa is C or S
VGKAXXVPTKLSATSVLYY

SEQ ID NO: 1374 - protein, 9 aa, Artificial Sequence
  GFR-binding peptide
LSAISVLYL

SEQ ID NO: 1375 - protein, 11 aa, Artificial Sequence
  GFR-binding peptide
VQLSPISVLYK

SEQ ID NO: 1376 - protein, 11 aa, Artificial Sequence
  GFR-binding peptide
QALSAISILYL

SEQ ID NO: 1377 - protein, 11 aa, Artificial Sequence
  GFR-binding peptide
TQLSPISVLYK

SEQ ID NO: 1378 - protein, 20 aa, Artificial Sequence
  GFR-binding peptide
  MOD_RES (6)..(7): Xaa is C or S
ASASPXXVPQDLSATSILYY

SEQ ID NO: 1379 - protein, 16 aa, Artificial Sequence
  GFR-binding peptide
  MOD_RES (2)..(3): Xaa is C or S
PXXVPQDLSAISILYL

SEQ ID NO: 1380 - protein, 17 aa, Artificial Sequence
  GFR-binding peptide
  MOD_RES (3)..(4): Xaa is C or S
KPXXAPTKLSATSVLYY

SEQ ID NO: 1381 - protein, 15 aa, Artificial Sequence
  GFR-binding peptide
  MOD_RES (1)..(2): Xaa is C or S
XXVPTKLSATSVLYY

SEQ ID NO: 1382 - protein, 20 aa, Artificial Sequence
  GFR-binding peptide
  MOD_RES (6)..(7): Xaa is C or S
KVGKAXXVPTKLSAISVLYL

SEQ ID NO: 1383 - protein, 19 aa, Artificial Sequence
  GFR-binding peptide
  MOD_RES (5)..(6): Xaa is C or S
VPKPXXAPTQLSPISVLYK

SEQ ID NO: 1384 - protein, 20 aa, Artificial Sequence
  GFR-binding peptide
  MOD_RES (6)..(7): Xaa is C or S
ASASPXXVSQDLSAISILYL

SEQ ID NO: 1385 - protein, 18 aa, Artificial Sequence
  GFR-binding peptide
  MOD_RES (4)..(5): Xaa is C or S
AAPXXVPQALNAISILYF

SEQ ID NO: 1386 - protein, 16 aa, Artificial Sequence
  GFR-binding peptide
  MOD_RES (2)..(3): Xaa is C or S
AXXAPTKLSPISVLYK

SEQ ID NO: 1387 - protein, 16 aa, Artificial Sequence
  GFR-binding peptide
  MOD_RES (3)..(3): Xaa is C or S
PTXAPTKLSPISVLYK

SEQ ID NO: 1388 - protein, 15 aa, Artificial Sequence
  GFR-binding peptide
  MOD_RES (1)..(2): Xaa is C or S
XXVSQDLNAISILYF

SEQ ID NO: 1389 - protein, 19 aa, Artificial Sequence
  GFR-binding peptide
  MOD_RES (5)..(6): Xaa is C or S
VPKPXXAPTKLSPISVLYK

SEQ ID NO: 1390 - protein, 13 aa, Artificial Sequence
  GFR-binding peptide
VPTKLSAISVLYL

SEQ ID NO: 1391 - protein, 16 aa, Artificial Sequence
  GFR-binding peptide
  MOD_RES (2)..(3): Xaa is C or S
PXXAPTKLSAISVLYL

SEQ ID NO: 1392 - protein, 15 aa, Artificial Sequence
  GFR-binding peptide
  MOD_RES (1)..(2): Xaa is C or S
XXVPQDLSATSILYY

SEQ ID NO: 1393 - protein, 13 aa, Artificial Sequence
  GFR-binding peptide
VPQDLSATSILYY

SEQ ID NO: 1394 - protein, 12 aa, Artificial Sequence
  GFR-binding peptide
QVQLSPISVLYK

SEQ ID NO: 1395 - protein, 11 aa, Artificial Sequence
  GFR-binding peptide
QALNAISILYF

SEQ ID NO: 1396 - protein, 20 aa, Artificial Sequence
  GFR-binding peptide
  MOD_RES (6)..(7): Xaa is C or S
ASASPXXVSQDLNAISILYF

SEQ ID NO: 1397 - protein, 14 aa, Artificial Sequence
  GFR-binding peptide
PTQVQLSAISVLYL

SEQ ID NO: 1398 - protein, 10 aa, Artificial Sequence
  GFR-binding peptide
QLSPISVLYK

SEQ ID NO: 1399 - protein, 11 aa, Artificial Sequence
  GFR-binding peptide
TQLSAISVLYL

SEQ ID NO: 1400 - protein, 13 aa, Artificial Sequence
  GFR-binding peptide
VSQDLNAISILYF

SEQ ID NO: 1401 - protein, 14 aa, Artificial Sequence
  GFR-binding peptide
  MOD_RES (1)..(1): Xaa is C or S
XAPTQLSAISVLYL

SEQ ID NO: 1402 - protein, 11 aa, Artificial Sequence
  GFR-binding peptide
QDLSAISILYL

SEQ ID NO: 1403 - protein, 16 aa, Artificial Sequence
  GFR-binding peptide
  MOD_RES (2)..(3): Xaa is C or S
PXXVPQDLSPISILYK

SEQ ID NO: 1404 - protein, 15 aa, Artificial Sequence
  GFR-binding peptide
  MOD_RES (1)..(2): Xaa is C or S
XXVSQDLSPISILYK

SEQ ID NO: 1405 - protein, 18 aa, Artificial Sequence
  GFR-binding peptide
  MOD_RES (4)..(5): Xaa is C or S
ASPXXVPQDLNAISILYF

SEQ ID NO: 1406 - protein, 11 aa, Artificial Sequence
  GFR-binding peptide
QALSPISILYK

SEQ ID NO: 1407 - protein, 20 aa, Artificial Sequence
  GFR-binding peptide
  MOD_RES (6)..(7): Xaa is C or S
ASASPXXVSQDLSPISILYK

SEQ ID NO: 1408 - protein, 15 aa, Artificial Sequence
  GFR-binding peptide
  MOD_RES (1)..(2): Xaa is C or S
XXVPTELSATSMLYY

SEQ ID NO: 1409 - protein, 17 aa, Artificial Sequence
  GFR-binding peptide
  MOD_RES (4)..(4): Xaa is C or S
KPTXAPTKLSPISVLYK

SEQ ID NO: 1410 - protein, 14 aa, Artificial Sequence
  GFR-binding peptide
  MOD_RES (1)..(1): Xaa is C or S
XVSQDLSATSILYY

SEQ ID NO: 1411 - protein, 13 aa, Artificial Sequence
  GFR-binding peptide
VSQDLSPISILYK

SEQ ID NO: 1412 - protein, 16 aa, Artificial Sequence
  GFR-binding peptide
  MOD_RES (2)..(3): Xaa is C or S
PXXVPQDLNAISILYF

SEQ ID NO: 1413 - protein, 13 aa, Artificial Sequence
  GFR-binding peptide
VPTELSATSMLYY

SEQ ID NO: 1414 - protein, 14 aa, Artificial Sequence
  GFR-binding peptide
  MOD_RES (1)..(1): Xaa is C or S
XAPTQLSATSVLYY

SEQ ID NO: 1415 - protein, 9 aa, Artificial Sequence
  GFR-binding peptide
LSPISILYK

SEQ ID NO: 1416 - protein, 16 aa, Artificial Sequence
  GFR-binding peptide
  MOD_RES (1)..(1): Xaa is C or S
XRPTQVQLSATSVLYY

SEQ ID NO: 1417 - protein, 15 aa, Artificial Sequence
  GFR-binding peptide
  MOD_RES (1)..(2): Xaa is C or S
XXVPQALSPISILYK

SEQ ID NO: 1418 - protein, 16 aa, Artificial Sequence
  GFR-binding peptide
  MOD_RES (2)..(3): Xaa is C or S
PXXAPTQLSPISVLYK

SEQ ID NO: 1419 - protein, 12 aa, Artificial Sequence
  GFR-binding peptide
QVQLNAISVLYF

SEQ ID NO: 1420 - protein, 16 aa, Artificial Sequence
  GFR-binding peptide
  MOD_RES (2)..(3): Xaa is C or S
AXXVPTELSATSMLYY

SEQ ID NO: 1421 - protein, 19 aa, Artificial Sequence
  GFR-binding peptide
  MOD_RES (5)..(6): Xaa is C or S
SASPXXVSQDLNAISILYF

SEQ ID NO: 1422 - protein, 17 aa, Artificial Sequence
  GFR-binding peptide
  MOD_RES (4)..(4): Xaa is C or S
KPTXAPTKLSATSVLYY

SEQ ID NO: 1423 - protein, 18 aa, Artificial Sequence
  GFR-binding peptide
  MOD_RES (4)..(5): Xaa is C or S
AAPXXVPQALSPISILYK

SEQ ID NO: 1424 - protein, 14 aa, Artificial Sequence
  GFR-binding peptide
PTQVQLSPISVLYK

SEQ ID NO: 1425 - protein, 13 aa, Artificial Sequence
  GFR-binding peptide
VPTKLSATSVLYY

SEQ ID NO: 1426 - protein, 20 aa, Artificial Sequence
  GFR-binding peptide
  MOD_RES (6)..(7): Xaa is C or S
YVPKPXXAPTKLSAISVLYL

SEQ ID NO: 1427 - protein, 16 aa, Artificial Sequence
  GFR-binding peptide
  MOD_RES (2)..(3): Xaa is C or S
PXXVPQALNAISILYF

SEQ ID NO: 1428 - protein, 10 aa, Artificial Sequence
  GFR-binding peptide
KLSAISVLYL

SEQ ID NO: 1429 - protein, 14 aa, Artificial Sequence
  GFR-binding peptide
  MOD_RES (1)..(1): Xaa is C or S
XAPTKLSPISVLYK

SEQ ID NO: 1430 - protein, 15 aa, Artificial Sequence
  GFR-binding peptide
  MOD_RES (1)..(2): Xaa is C or S
XXVSQDLSAISILYL

SEQ ID NO: 1431 - protein, 18 aa, Artificial Sequence
  GFR-binding peptide
  MOD_RES (4)..(5): Xaa is C or S
PKPXXAPTQLSPISVLYK

SEQ ID NO: 1432 - protein, 13 aa, Artificial Sequence
  GFR-binding peptide
APTQLSPISVLYK

SEQ ID NO: 1433 - protein, 18 aa, Artificial Sequence
  GFR-binding peptide
  MOD_RES (4)..(5): Xaa is C or S
ASPXXVSQDLSATSILYY

SEQ ID NO: 1434 - protein, 10 aa, Artificial Sequence
  GFR-binding peptide
ALSPISILYK

SEQ ID NO: 1435 - protein, 18 aa, Artificial Sequence
  GFR-binding peptide
  MOD_RES (4)..(5): Xaa is C or S
PKAXXVPTELSATSMLYY

SEQ ID NO: 1436 - protein, 17 aa, Artificial Sequence
  GFR-binding peptide
  MOD_RES (3)..(4): Xaa is C or S
KAXXAPTKLSPISVLYK

SEQ ID NO: 1437 - protein, 12 aa, Artificial Sequence
  GFR-binding peptide
PQALSATSILYY

SEQ ID NO: 1438 - protein, 14 aa, Artificial Sequence
  GFR-binding peptide
  MOD_RES (1)..(1): Xaa is C or S
XVPQALSATSILYY

SEQ ID NO: 1439 - protein, 12 aa, Artificial Sequence
  GFR-binding peptide
PQDLSPISILYK

SEQ ID NO: 1440 - protein, 13 aa, Artificial Sequence
  GFR-binding peptide
VPQALSPISILYK

SEQ ID NO: 1441 - protein, 20 aa, Artificial Sequence
  GFR-binding peptide
  MOD_RES (6)..(7): Xaa is C or S
ASAAPXXVPQALSATSILYY

SEQ ID NO: 1442 - protein, 13 aa, Artificial Sequence
  GFR-binding peptide
TQVQLSATSVLYY

SEQ ID NO: 1443 - protein, 15 aa, Artificial Sequence
  GFR-binding peptide
  MOD_RES (1)..(2): Xaa is C or S
XXAPTQLSPISVLYK

SEQ ID NO: 1444 - protein, 11 aa, Artificial Sequence
  GFR-binding peptide
TELSATSMLYY

SEQ ID NO: 1445 - protein, 19 aa, Artificial Sequence
  GFR-binding peptide
  MOD_RES (5)..(6): Xaa is C or S
SAAPXXVPQALSAISILYL

SEQ ID NO: 1446 - protein, 15 aa, Artificial Sequence
  GFR-binding peptide
  MOD_RES (1)..(2): Xaa is C or S
XXVPTELNAISMLYF

SEQ ID NO: 1447 - protein, 18 aa, Artificial Sequence
  GFR-binding peptide
  MOD_RES (4)..(5): Xaa is C or S
PKPXXAPTKLSATSVLYY

SEQ ID NO: 1448 - protein, 14 aa, Artificial Sequence
  GFR-binding peptide
  MOD_RES (1)..(1): Xaa is C or S
XVPQDLSPISILYK

SEQ ID NO: 1449 - protein, 20 aa, Artificial Sequence
  GFR-binding peptide
  MOD_RES (6)..(7): Xaa is C or S
ASASPXXVPQDLSAISILYL

SEQ ID NO: 1450 - protein, 19 aa, Artificial Sequence
  GFR-binding peptide
  MOD_RES (6)..(6): Xaa is C or S
VTKPTXAPTKLSPISVLYK

SEQ ID NO: 1451 - protein, 15 aa, Artificial Sequence
  GFR-binding peptide
  MOD_RES (2)..(2): Xaa is C or S
TXAPTKLSAISVLYL

SEQ ID NO: 1452 - protein, 18 aa, Artificial Sequence
  GFR-binding peptide
  MOD_RES (4)..(5): Xaa is C or S
PKAXXAPTKLSPISVLYK

SEQ ID NO: 1453 - protein, 12 aa, Artificial Sequence
  GFR-binding peptide
PTKLSAISVLYL

SEQ ID NO: 1454 - protein, 15 aa, Artificial Sequence
  GFR-binding peptide
  MOD_RES (1)..(2): Xaa is C or S
XXVPQDLSPISILYK

SEQ ID NO: 1455 - protein, 15 aa, Artificial Sequence
  GFR-binding peptide
RPTQVQLSPISVLYK

SEQ ID NO: 1456 - protein, 17 aa, Artificial Sequence
  GFR-binding peptide
  MOD_RES (2)..(2): Xaa is C or S
QXRPTQVQLNAISVLYF

SEQ ID NO: 1457 - protein, 13 aa, Artificial Sequence
  GFR-binding peptide
VPTELNAISMLYF

SEQ ID NO: 1458 - protein, 19 aa, Artificial Sequence
  GFR-binding peptide
  MOD_RES (5)..(6): Xaa is C or S
VPKPXXAPTKLSATSVLYY

SEQ ID NO: 1459 - protein, 20 aa, Artificial Sequence
  GFR-binding peptide
  MOD_RES (6)..(7): Xaa is C or S
ASAAPXXVPQALSPISILYK

SEQ ID NO: 1460 - protein, 18 aa, Artificial Sequence
  GFR-binding peptide
  MOD_RES (4)..(5): Xaa is C or S
PKPXXAPTQLSATSVLYY

SEQ ID NO: 1461 - protein, 20 aa, Artificial Sequence
  GFR-binding peptide
  MOD_RES (6)..(7): Xaa is C or S
KIPKAXXVPTELSPISMLYK

SEQ ID NO: 1462 - protein, 17 aa, Artificial Sequence
  GFR-binding peptide
  MOD_RES (3)..(4): Xaa is C or S
KPXXAPTQLSATSVLYY

SEQ ID NO: 1463 - protein, 20 aa, Artificial Sequence
  GFR-binding peptide
  MOD_RES (6)..(7): Xaa is C or S
ASASPXXVSQDLSATSILYY

SEQ ID NO: 1464 - protein, 16 aa, Artificial Sequence
  GFR-binding peptide
  MOD_RES (2)..(3): Xaa is C or S
AXXVPTKLSATSVLYY

SEQ ID NO: 1465 - protein, 12 aa, Artificial Sequence
  GFR-binding peptide
SQDLSPISILYK

SEQ ID NO: 1466 - protein, 20 aa, Artificial Sequence
  GFR-binding peptide
  MOD_RES (6)..(7): Xaa is C or S
KIPKAXXVPTELSATSMLYY

SEQ ID NO: 1467 - protein, 17 aa, Artificial Sequence
  GFR-binding peptide
  MOD_RES (3)..(4): Xaa is C or S
KPXXAPTKLSPISVLYK

SEQ ID NO: 1468 - protein, 17 aa, Artificial Sequence
  GFR-binding peptide
  MOD_RES (3)..(4): Xaa is C or S
KPXXAPTQLSPISVLYK

SEQ ID NO: 1469 - protein, 12 aa, Artificial Sequence
  GFR-binding peptide
PQDLSATSILYY

SEQ ID NO: 1470 - protein, 16 aa, Artificial Sequence
  GFR-binding peptide
  MOD_RES (2)..(3): Xaa is C or S
PXXVSQDLNAISILYF

SEQ ID NO: 1471 - protein, 14 aa, Artificial Sequence
  GFR-binding peptide
  MOD_RES (1)..(1): Xaa is C or S
XVPQDLSATSILYY

SEQ ID NO: 1472 - protein, 14 aa, Artificial Sequence
  GFR-binding peptide
  MOD_RES (1)..(1): Xaa is C or S
XVPQALSPISILYK

SEQ ID NO: 1473 - protein, 18 aa, Artificial Sequence
  GFR-binding peptide
  MOD_RES (3)..(3): Xaa is C or S
VQXRPTQVQLSPISVLYK

SEQ ID NO: 1474 - protein, 14 aa, Artificial Sequence
  GFR-binding peptide
  MOD_RES (1)..(1): Xaa is C or S
XVPTELNAISMLYF

SEQ ID NO: 1475 - protein, 13 aa, Artificial Sequence
  GFR-binding peptide
TQVQLSPISVLYK

SEQ ID NO: 1476 - protein, 17 aa, Artificial Sequence
  GFR-binding peptide
  MOD_RES (3)..(4): Xaa is C or S
SPXXVSQDLSAISILYL

SEQ ID NO: 1477 - protein, 20 aa, Artificial Sequence
  GFR-binding peptide
  MOD_RES (6)..(7): Xaa is C or S
ASASPXXVPQDLNAISILYF

SEQ ID NO: 1478 - protein, 18 aa, Artificial Sequence
  GFR-binding peptide
  MOD_RES (5)..(5): Xaa is C or S
TKPTXAPTKLSPISVLYK

SEQ ID NO: 1479 - protein, 12 aa, Artificial Sequence
  GFR-binding peptide
PTQLSAISVLYL

SEQ ID NO: 1480 - protein, 18 aa, Artificial Sequence
  GFR-binding peptide
  MOD_RES (4)..(5): Xaa is C or S
PKPXXAPTKLSPISVLYK

SEQ ID NO: 1481 - protein, 14 aa, Artificial Sequence
  GFR-binding peptide
  MOD_RES (1)..(1): Xaa is C or S
XVPTKLNAISVLYF

SEQ ID NO: 1482 - protein, 10 aa, Artificial Sequence
  GFR-binding peptide
DLSPISILYK

SEQ ID NO: 1483 - protein, 15 aa, Artificial Sequence
  GFR-binding peptide
  MOD_RES (1)..(2): Xaa is C or S
XXAPTQLSATSVLYY

SEQ ID NO: 1484 - protein, 14 aa, Artificial Sequence
  GFR-binding peptide
  MOD_RES (1)..(1): Xaa is C or S
XVPTKLSAISVLYL

SEQ ID NO: 1485 - protein, 13 aa, Artificial Sequence
  GFR-binding peptide
APTKLSPISVLYK

SEQ ID NO: 1486 - protein, 19 aa, Artificial Sequence
  GFR-binding peptide
  MOD_RES (6)..(6): Xaa is C or S
VTKPTXAPTKLSATSVLYY

SEQ ID NO: 1487 - protein, 16 aa, Artificial Sequence
  GFR-binding peptide
  MOD_RES (2)..(3): Xaa is C or S
PXXVSQDLSAISILYL

SEQ ID NO: 1488 - protein, 13 aa, Artificial Sequence
  GFR-binding peptide
APTQLSATSVLYY

SEQ ID NO: 1489 - protein, 19 aa, Artificial Sequence
  GFR-binding peptide
  MOD_RES (4)..(4): Xaa is C or S
NVQXRPTQVQLSPISVLYK

SEQ ID NO: 1490 - protein, 17 aa, Artificial Sequence
  GFR-binding peptide
  MOD_RES (3)..(4): Xaa is C or S
SPXXVSQDLNAISILYF

SEQ ID NO: 1491 - protein, 11 aa, Artificial Sequence
  GFR-binding peptide
VQLSATSVLYY

SEQ ID NO: 1492 - protein, 13 aa, Artificial Sequence
  GFR-binding peptide
LYLVSIASLQTPA

SEQ ID NO: 1493 - protein, 18 aa, Artificial Sequence
  GFR-binding peptide
  MOD_RES (14)..(15): Xaa is C or S
KYLMSIPSLETPVXXAKP

SEQ ID NO: 1494 - protein, 10 aa, Artificial Sequence
  GFR-binding peptide
YYLISTASLA

SEQ ID NO: 1495 - protein, 10 aa, Artificial Sequence
  GFR-binding peptide
KYLMSIPSLE

SEQ ID NO: 1496 - protein, 18 aa, Artificial Sequence
  GFR-binding peptide
  MOD_RES (14)..(15): Xaa is C or S
KYLISIPSLDQSVXXPSA

SEQ ID NO: 1497 - protein, 19 aa, Artificial Sequence
  GFR-binding peptide
  MOD_RES (14)..(15): Xaa is C or S
YYLISTASLDQSVXXPSAS

SEQ ID NO: 1498 - protein, 19 aa, Artificial Sequence
  GFR-binding peptide
  MOD_RES (14)..(15): Xaa is C or S
LYLISIASLDQSVXXPSAS

SEQ ID NO: 1499 - protein, 11 aa, Artificial Sequence
  GFR-binding peptide
FYLISIANLDQ

SEQ ID NO: 1500 - protein, 13 aa, Artificial Sequence
  GFR-binding peptide
LYLISIASLAQPV

SEQ ID NO: 1501 - protein, 10 aa, Artificial Sequence
  GFR-binding peptide
LYLISIASLA

SEQ ID NO: 1502 - protein, 16 aa, Artificial Sequence
  GFR-binding peptide
  MOD_RES (14)..(15): Xaa is C or S
YYLVSTASLQTPAXXP

SEQ ID NO: 1503 - protein, 16 aa, Artificial Sequence
  GFR-binding peptide
  MOD_RES (14)..(15): Xaa is C or S
YYLISTASLAQPVXXP

SEQ ID NO: 1504 - protein, 12 aa, Artificial Sequence
  GFR-binding peptide
KYLISIPSLAQP

SEQ ID NO: 1505 - protein, 13 aa, Artificial Sequence
  GFR-binding peptide
YYLISTASLDQSV

SEQ ID NO: 1506 - protein, 10 aa, Artificial Sequence
  GFR-binding peptide
FYLMSIANLE

SEQ ID NO: 1507 - protein, 18 aa, Artificial Sequence
  GFR-binding peptide
  MOD_RES (14)..(15): Xaa is C or S
YYLISTASLDQPVXXPSA

SEQ ID NO: 1508 - protein, 18 aa, Artificial Sequence
  GFR-binding peptide
  MOD_RES (14)..(15): Xaa is C or S
YYLISTASLAQPVXXPAA

SEQ ID NO: 1509 - protein, 12 aa, Artificial Sequence
  GFR-binding peptide
LYLISIASLDQS

SEQ ID NO: 1510 - protein, 18 aa, Artificial Sequence
  GFR-binding peptide
  MOD_RES (14)..(15): Xaa is C or S
FYLVSIANLKTPAXXAKP

SEQ ID NO: 1511 - protein, 17 aa, Artificial Sequence
  GFR-binding peptide
  MOD_RES (16)..(16): Xaa is C or S
KYLVSIPSLQVQTPRXQ

SEQ ID NO: 1512 - protein, 18 aa, Artificial Sequence
  GFR-binding peptide
  MOD_RES (16)..(16): Xaa is C or S
LYLVSIASLQVQTPRXQV

SEQ ID NO: 1513 - protein, 12 aa, Artificial Sequence
  GFR-binding peptide
YYLVSTASLKTP

SEQ ID NO: 1514 - protein, 10 aa, Artificial Sequence
  GFR-binding peptide
KYLVSIPSLK

SEQ ID NO: 1515 - protein, 10 aa, Artificial Sequence
  GFR-binding peptide
FYLVSIANLK

SEQ ID NO: 1516 - protein, 16 aa, Artificial Sequence
  GFR-binding peptide
  MOD_RES (14)..(15): Xaa is C or S
LYLISIASLAQPVXXP

SEQ ID NO: 1517 - protein, 12 aa, Artificial Sequence
  GFR-binding peptide
KYLVSIPSLQTP

SEQ ID NO: 1518 - protein, 16 aa, Artificial Sequence
  GFR-binding peptide
  MOD_RES (14)..(15): Xaa is C or S
LYLVSIASLQTPAXXP

SEQ ID NO: 1519 - protein, 18 aa, Artificial Sequence
  GFR-binding peptide
  MOD_RES (14)..(15): Xaa is C or S
FYLVSIANLQTPAXXPKP

SEQ ID NO: 1520 - protein, 17 aa, Artificial Sequence
  GFR-binding peptide
  MOD_RES (16)..(16): Xaa is C or S
LYLVSIASLQVQTPRXQ

SEQ ID NO: 1521 - protein, 19 aa, Artificial Sequence
  GFR-binding peptide
  MOD_RES (14)..(15): Xaa is C or S
YYLVSTASLQTPAXXPKPV

SEQ ID NO: 1522 - protein, 13 aa, Artificial Sequence
  GFR-binding peptide
LYLISIASLDQSV

SEQ ID NO: 1523 - protein, 14 aa, Artificial Sequence
  GFR-binding peptide
FYLVSIANLQVQTP

SEQ ID NO: 1524 - protein, 11 aa, Artificial Sequence
  GFR-binding peptide
FYLVSIANLKT

SEQ ID NO: 1525 - protein, 17 aa, Artificial Sequence
  GFR-binding peptide
  MOD_RES (14)..(15): Xaa is C or S
FYLISIANLDQPVXXPS

SEQ ID NO: 1526 - protein, 16 aa, Artificial Sequence
  GFR-binding peptide
  MOD_RES (14)..(15): Xaa is C or S
LYLVSIASLKTPAXXA

SEQ ID NO: 1527 - protein, 18 aa, Artificial Sequence
  GFR-binding peptide
  MOD_RES (14)..(15): Xaa is C or S
LYLISIASLDQPVXXPSA

SEQ ID NO: 1528 - protein, 15 aa, Artificial Sequence
  GFR-binding peptide
  MOD_RES (14)..(15): Xaa is C or S
LYLISIASLAQPVXX

SEQ ID NO: 1529 - protein, 18 aa, Artificial Sequence
  GFR-binding peptide
  MOD_RES (14)..(15): Xaa is C or S
LYLVSIASLKTPVXXAKG

SEQ ID NO: 1530 - protein, 11 aa, Artificial Sequence
  GFR-binding peptide
KYLISIPSLDQ

SEQ ID NO: 1531 - protein, 18 aa, Artificial Sequence
  GFR-binding peptide
  MOD_RES (16)..(16): Xaa is C or S
YYLVSTASLQVQTPRXQV

SEQ ID NO: 1532 - protein, 9 aa, Artificial Sequence
  GFR-binding peptide
YYLMSTASL

SEQ ID NO: 1533 - protein, 18 aa, Artificial Sequence
  GFR-binding peptide
  MOD_RES (14)..(15): Xaa is C or S
FYLMSIANLETPVXXAKP

SEQ ID NO: 1534 - protein, 13 aa, Artificial Sequence
  GFR-binding peptide
YYLISTASLAQPV

SEQ ID NO: 1535 - protein, 15 aa, Artificial Sequence
  GFR-binding peptide
  MOD_RES (14)..(14): Xaa is C or S
YYLVSTASLKTPAXT

SEQ ID NO: 1536 - protein, 11 aa, Artificial Sequence
  GFR-binding peptide
KYLMSIPSLET

SEQ ID NO: 1537 - protein, 11 aa, Artificial Sequence
  GFR-binding peptide
KYLVSIPSLKT

SEQ ID NO: 1538 - protein, 17 aa, Artificial Sequence
  GFR-binding peptide
  MOD_RES (16)..(16): Xaa is C or S
YYLVSTASLQVQTPRXQ

SEQ ID NO: 1539 - protein, 17 aa, Artificial Sequence
  GFR-binding peptide
  MOD_RES (14)..(15): Xaa is C or S
KYLISIPSLAQPVXXPA

SEQ ID NO: 1540 - protein, 18 aa, Artificial Sequence
  GFR-binding peptide
  MOD_RES (14)..(15): Xaa is C or S
FYLVSIANLKTPVXXAKG

SEQ ID NO: 1541 - protein, 20 aa, Artificial Sequence
  GFR-binding peptide
  MOD_RES (14)..(15): Xaa is C or S
YYLMSTASLETPVXXAKPIS

SEQ ID NO: 1542 - protein, 15 aa, Artificial Sequence
  GFR-binding peptide
  MOD_RES (14)..(15): Xaa is C or S
YYLISTASLAQPVXX

SEQ ID NO: 1543 - protein, 17 aa, Artificial Sequence
  GFR-binding peptide
  MOD_RES (14)..(15): Xaa is C or S
FYLMSIANLETPVXXAK

SEQ ID NO: 1544 - protein, 17 aa, Artificial Sequence
  GFR-binding peptide
  MOD_RES (14)..(15): Xaa is C or S
FYLISIANLAQPVXXPA

SEQ ID NO: 1545 - protein, 18 aa, Artificial Sequence
  GFR-binding peptide
  MOD_RES (14)..(15): Xaa is C or S
KYLVSIPSLKTPVXXAKG

SEQ ID NO: 1546 - protein, 20 aa, Artificial Sequence
  GFR-binding peptide
  MOD_RES (14)..(15): Xaa is C or S
LYLVSIASLQTPAXXPKPVT

SEQ ID NO: 1547 - protein, 18 aa, Artificial Sequence
  GFR-binding peptide
  MOD_RES (14)..(15): Xaa is C or S
LYLMSIASLETPVXXAKP

SEQ ID NO: 1548 - protein, 18 aa, Artificial Sequence
  GFR-binding peptide
  MOD_RES (14)..(15): Xaa is C or S
LYLISIASLAQPVXXPAA

SEQ ID NO: 1549 - protein, 19 aa, Artificial Sequence
  GFR-binding peptide
  MOD_RES (14)..(15): Xaa is C or S
LYLVSIASLQTPAXXPKPV

SEQ ID NO: 1550 - protein, 11 aa, Artificial Sequence
  GFR-binding peptide
FYLMSIANLET

SEQ ID NO: 1551 - protein, 17 aa, Artificial Sequence
  GFR-binding peptide
  MOD_RES (14)..(15): Xaa is C or S
KYLMSIPSLETPVXXAK

SEQ ID NO: 1552 - protein, 12 aa, Artificial Sequence
  GFR-binding peptide
YYLISTASLDQS

SEQ ID NO: 1553 - protein, 14 aa, Artificial Sequence
  GFR-binding peptide
  MOD_RES (14)..(14): Xaa is C or S
LYLISIASLAQPVX

SEQ ID NO: 1554 - protein, 11 aa, Artificial Sequence
  GFR-binding peptide
LYLMSIASLET

SEQ ID NO: 1555 - protein, 20 aa, Artificial Sequence
  GFR-binding peptide
  MOD_RES (14)..(14): Xaa is C or S
LYLVSIASLKTPAXTPKTVH

SEQ ID NO: 1556 - protein, 18 aa, Artificial Sequence
  GFR-binding peptide
  MOD_RES (14)..(15): Xaa is C or S
KYLISIPSLDQPVXXPSA

SEQ ID NO: 1557 - protein, 13 aa, Artificial Sequence
  GFR-binding peptide
LYLVSIASLKTPA

SEQ ID NO: 1558 - protein, 14 aa, Artificial Sequence
  GFR-binding peptide
  MOD_RES (14)..(14): Xaa is C or S
KYLVSIPSLKTPVX

SEQ ID NO: 1559 - protein, 19 aa, Artificial Sequence
  GFR-binding peptide
  MOD_RES (14)..(15): Xaa is C or S
YYLISTASLAQPVXXPAAS

SEQ ID NO: 1560 - protein, 17 aa, Artificial Sequence
  GFR-binding peptide
  MOD_RES (14)..(15): Xaa is C or S
FYLVSIANLKTPAXXAK

SEQ ID NO: 1561 - protein, 17 aa, Artificial Sequence
  GFR-binding peptide
  MOD_RES (14)..(15): Xaa is C or S
KYLISIPSLDQPVXXPS

SEQ ID NO: 1562 - protein, 19 aa, Artificial Sequence
  GFR-binding peptide
  MOD_RES (14)..(15): Xaa is C or S
YYLISTASLDQPVXXPSAS

SEQ ID NO: 1563 - protein, 16 aa, Artificial Sequence
  GFR-binding peptide
  MOD_RES (16)..(16): Xaa is C or S
LYLVSIASLQVQTPRX

SEQ ID NO: 1564 - protein, 19 aa, Artificial Sequence
  GFR-binding peptide
  MOD_RES (14)..(15): Xaa is C or S
LYLVSIASLKTPAXXAKPV

SEQ ID NO: 1565 - protein, 16 aa, Artificial Sequence
  GFR-binding peptide
  MOD_RES (14)..(15): Xaa is C or S
KYLISIPSLAQPVXXP

SEQ ID NO: 1566 - protein, 14 aa, Artificial Sequence
  GFR-binding peptide
  MOD_RES (14)..(14): Xaa is C or S
FYLVSIANLKTPAX

SEQ ID NO: 1567 - protein, 16 aa, Artificial Sequence
  GFR-binding peptide
  MOD_RES (14)..(15): Xaa is C or S
YYLVSTASLKTPAXXP

SEQ ID NO: 1568 - protein, 19 aa, Artificial Sequence
  GFR-binding peptide
  MOD_RES (14)..(15): Xaa is C or S
LYLISIASLDQPVXXPSAS

SEQ ID NO: 1569 - protein, 17 aa, Artificial Sequence
  GFR-binding peptide
  MOD_RES (14)..(15): Xaa is C or S
FYLVSIANLKTPVXXAK

SEQ ID NO: 1570 - protein, 15 aa, Artificial Sequence
  GFR-binding peptide
FYLVSIANLQVQTPR

SEQ ID NO: 1571 - protein, 16 aa, Artificial Sequence
  GFR-binding peptide
  MOD_RES (14)..(15): Xaa is C or S
LYLMSIASLETPVXXA

SEQ ID NO: 1572 - protein, 19 aa, Artificial Sequence
  GFR-binding peptide
  MOD_RES (14)..(15): Xaa is C or S
KYLISIPSLDQSVXXPSAS

SEQ ID NO: 1573 - protein, 19 aa, Artificial Sequence
  GFR-binding peptide
  MOD_RES (14)..(14): Xaa is C or S
FYLVSIANLKTPAXTPKTV

SEQ ID NO: 1574 - protein, 17 aa, Artificial Sequence
  GFR-binding peptide
  MOD_RES (14)..(14): Xaa is C or S
LYLVSIASLKTPAXTPK

SEQ ID NO: 1575 - protein, 15 aa, Artificial Sequence
  GFR-binding peptide
  MOD_RES (14)..(15): Xaa is C or S
FYLISIANLDQPVXX

SEQ ID NO: 1576 - protein, 14 aa, Artificial Sequence
  GFR-binding peptide
  MOD_RES (14)..(14): Xaa is C or S
KYLMSIPSLETPVX

SEQ ID NO: 1577 - protein, 17 aa, Artificial Sequence
  GFR-binding peptide
  MOD_RES (14)..(15): Xaa is C or S
YYLISTASLDQSVXXPS

SEQ ID NO: 1578 - protein, 8 aa, Artificial Sequence
  GFR-binding peptide
LYLMSIAS

SEQ ID NO: 1579 - protein, 11 aa, Artificial Sequence
  GFR-binding peptide
LYLVSIASLKT

SEQ ID NO: 1580 - protein, 11 aa, Artificial Sequence
  GFR-binding peptide
YYLISTASLAQ

SEQ ID NO: 1581 - protein, 11 aa, Artificial Sequence
  GFR-binding peptide
YYLISTASLDQ

SEQ ID NO: 1582 - protein, 12 aa, Artificial Sequence
  GFR-binding peptide
YYLMSTASLETP

SEQ ID NO: 1583 - protein, 20 aa, Artificial Sequence
  GFR-binding peptide
  MOD_RES (14)..(15): Xaa is C or S
FYLMSIANLETPVXXAKPIK

SEQ ID NO: 1584 - protein, 18 aa, Artificial Sequence
  GFR-binding peptide
  MOD_RES (16)..(16): Xaa is C or S
FYLVSIANLQVQTPRXQV

SEQ ID NO: 1585 - protein, 15 aa, Artificial Sequence
  GFR-binding peptide
  MOD_RES (14)..(15): Xaa is C or S
FYLVSIANLQTPAXX

SEQ ID NO: 1586 - protein, 17 aa, Artificial Sequence
  GFR-binding peptide
  MOD_RES (14)..(15): Xaa is C or S
LYLVSIASLKTPAXXPK

SEQ ID NO: 1587 - protein, 18 aa, Artificial Sequence
  GFR-binding peptide
  MOD_RES (14)..(15): Xaa is C or S
LYLVSIASLKTPAXXAKP

SEQ ID NO: 1588 - protein, 12 aa, Artificial Sequence
  GFR-binding peptide
FYLISIANLDQS

SEQ ID NO: 1589 - protein, 11 aa, Artificial Sequence
  GFR-binding peptide
FYLVSIANLQV

SEQ ID NO: 1590 - protein, 10 aa, Artificial Sequence
  GFR-binding peptide
FYLISIANLA

SEQ ID NO: 1591 - protein, 20 aa, Artificial Sequence
  GFR-binding peptide
  MOD_RES (14)..(15): Xaa is C or S
KYLVSIPSLKTPVXXAKGVK

SEQ ID NO: 1592 - protein, 15 aa, Artificial Sequence
  GFR-binding peptide
  MOD_RES (14)..(15): Xaa is C or S
FYLISIANLAQPVXX

SEQ ID NO: 1593 - protein, 13 aa, Artificial Sequence
  GFR-binding peptide
FYLVSIANLQTPA

SEQ ID NO: 1594 - protein, 13 aa, Artificial Sequence
  GFR-binding peptide
LYLISIASLDQPV

SEQ ID NO: 1595 - protein, 13 aa, Artificial Sequence
  GFR-binding peptide
FYLISIANLAQPV

SEQ ID NO: 1596 - protein, 12 aa, Artificial Sequence
  GFR-binding peptide
KYLMSIPSLETP

SEQ ID NO: 1597 - protein, 14 aa, Artificial Sequence
  GFR-binding peptide
  MOD_RES (14)..(14): Xaa is C or S
YYLMSTASLETPVX

SEQ ID NO: 1598 - protein, 14 aa, Artificial Sequence
  GFR-binding peptide
  MOD_RES (14)..(14): Xaa is C or S
LYLISIASLDQPVX

SEQ ID NO: 1599 - protein, 9 aa, Artificial Sequence
  GFR-binding peptide
KYLMSIPSL

SEQ ID NO: 1600 - protein, 15 aa, Artificial Sequence
  GFR-binding peptide
  MOD_RES (14)..(14): Xaa is C or S
KYLVSIPSLKTPAXT

SEQ ID NO: 1601 - protein, 18 aa, Artificial Sequence
  GFR-binding peptide
  MOD_RES (14)..(15): Xaa is C or S
LYLVSIASLKTPAXXPKP

SEQ ID NO: 1602 - protein, 14 aa, Artificial Sequence
  GFR-binding peptide
  MOD_RES (14)..(14): Xaa is C or S
FYLISIANLDQSVX

SEQ ID NO: 1603 - protein, 16 aa, Artificial Sequence
  GFR-binding peptide
  MOD_RES (14)..(15): Xaa is C or S
YYLISTASLDQPVXXP

SEQ ID NO: 1604 - protein, 18 aa, Artificial Sequence
  GFR-binding peptide
  MOD_RES (14)..(15): Xaa is C or S
YYLVSTASLKTPVXXAKG

SEQ ID NO: 1605 - protein, 15 aa, Artificial Sequence
  GFR-binding peptide
  MOD_RES (14)..(15): Xaa is C or S
KYLMSIPSLETPVXX

SEQ ID NO: 1606 - protein, 14 aa, Artificial Sequence
  GFR-binding peptide
  MOD_RES (14)..(14): Xaa is C or S
FYLISIANLDQPVX

SEQ ID NO: 1607 - protein, 16 aa, Artificial Sequence
  GFR-binding peptide
  MOD_RES (14)..(15): Xaa is C or S
YYLISTASLDQSVXXP

SEQ ID NO: 1608 - protein, 16 aa, Artificial Sequence
  GFR-binding peptide
  MOD_RES (14)..(15): Xaa is C or S
YYLVSTASLKTPAXXA

SEQ ID NO: 1609 - protein, 13 aa, Artificial Sequence
  GFR-binding peptide
FYLISIANLDQPV

SEQ ID NO: 1610 - protein, 20 aa, Artificial Sequence
  GFR-binding peptide
  MOD_RES (14)..(15): Xaa is C or S
KYLISIPSLDQPVXXPSASA

SEQ ID NO: 1611 - protein, 17 aa, Artificial Sequence
  GFR-binding peptide
  MOD_RES (14)..(15): Xaa is C or S
FYLVSIANLQTPAXXPK

SEQ ID NO: 1612 - protein, 15 aa, Artificial Sequence
  GFR-binding peptide
  MOD_RES (14)..(15): Xaa is C or S
YYLISTASLDQSVXX

SEQ ID NO: 1613 - protein, 19 aa, Artificial Sequence
  GFR-binding peptide
  MOD_RES (14)..(15): Xaa is C or S
FYLVSIANLKTPVXXAKGV

SEQ ID NO: 1614 - protein, 15 aa, Artificial Sequence
  GFR-binding peptide
  MOD_RES (14)..(15): Xaa is C or S
LYLVSIASLKTPAXX

SEQ ID NO: 1615 - protein, 16 aa, Artificial Sequence
  GFR-binding peptide
  MOD_RES (14)..(15): Xaa is C or S
FYLVSIANLKTPVXXA

SEQ ID NO: 1616 - protein, 9 aa, Artificial Sequence
  GFR-binding peptide
LYLISIASL

SEQ ID NO: 1617 - protein, 17 aa, Artificial Sequence
  GFR-binding peptide
  MOD_RES (14)..(15): Xaa is C or S
FYLVSIANLKTPAXXPK

SEQ ID NO: 1618 - protein, 16 aa, Artificial Sequence
  GFR-binding peptide
  MOD_RES (14)..(15): Xaa is C or S
KYLISIPSLDQSVXXP

SEQ ID NO: 1619 - protein, 10 aa, Artificial Sequence
  GFR-binding peptide
FYLISIANLD

SEQ ID NO: 1620 - protein, 8 aa, Artificial Sequence
  GFR-binding peptide
FYLVSIAN

SEQ ID NO: 1621 - protein, 18 aa, Artificial Sequence
  GFR-binding peptide
  MOD_RES (14)..(15): Xaa is C or S
LYLVSIASLQTPAXXPKP

SEQ ID NO: 1622 - protein, 16 aa, Artificial Sequence
  GFR-binding peptide
  MOD_RES (14)..(15): Xaa is C or S
FYLVSIANLQTPAXXP

SEQ ID NO: 1623 - protein, 15 aa, Artificial Sequence
  GFR-binding peptide
  MOD_RES (14)..(15): Xaa is C or S
LYLVSIASLQTPAXX

SEQ ID NO: 1624 - protein, 20 aa, Artificial Sequence
  GFR-binding peptide
  MOD_RES (14)..(15): Xaa is C or S
LYLMSIASLETPVXXAKPIK

SEQ ID NO: 1625 - protein, 20 aa, Artificial Sequence
  GFR-binding peptide
  MOD_RES (14)..(15): Xaa is C or S
FYLISIANLAQPVXXPAASA

SEQ ID NO: 1626 - protein, 13 aa, Artificial Sequence
  GFR-binding peptide
LYLVSIASLQVQT

SEQ ID NO: 1627 - protein, 19 aa, Artificial Sequence
  GFR-binding peptide
  MOD_RES (14)..(14): Xaa is C or S
LYLVSIASLKTPAXTPKTV

SEQ ID NO: 1628 - protein, 20 aa, Artificial Sequence
  GFR-binding peptide
  MOD_RES (14)..(15): Xaa is C or S
LYLISIASLAQPVXXPAASA

SEQ ID NO: 1629 - protein, 13 aa, Artificial Sequence
  GFR-binding peptide
FYLVSIANLQVQT

SEQ ID NO: 1630 - protein, 18 aa, Artificial Sequence
  GFR-binding peptide
  MOD_RES (14)..(15): Xaa is C or S
FYLISIANLDQSVXXPSA

SEQ ID NO: 1631 - protein, 12 aa, Artificial Sequence
  GFR-binding peptide
LYLISIASLAQP

SEQ ID NO: 1632 - protein, 16 aa, Artificial Sequence
  GFR-binding peptide
  MOD_RES (14)..(15): Xaa is C or S
LYLVSIASLKTPVXXA

SEQ ID NO: 1633 - protein, 18 aa, Artificial Sequence
  GFR-binding peptide
  MOD_RES (14)..(14): Xaa is C or S
FYLVSIANLKTPAXTPKT

SEQ ID NO: 1634 - protein, 12 aa, Artificial Sequence
  GFR-binding peptide
FYLISIANLAQP

SEQ ID NO: 1635 - protein, 12 aa, Artificial Sequence
  GFR-binding peptide
KYLVSIPSLKTP

SEQ ID NO: 1636 - protein, 20 aa, Artificial Sequence
  GFR-binding peptide
  MOD_RES (14)..(15): Xaa is C or S
YYLVSTASLKTPAXXAKPVA

SEQ ID NO: 1637 - protein, 12 aa, Artificial Sequence
  GFR-binding peptide
LYLISIASLDQP

SEQ ID NO: 1638 - protein, 10 aa, Artificial Sequence
  GFR-binding peptide
YYLVSTASLK

SEQ ID NO: 1639 - protein, 19 aa, Artificial Sequence
  GFR-binding peptide
  MOD_RES (16)..(16): Xaa is C or S
FYLVSIANLQVQTPRXQVN

SEQ ID NO: 1640 - protein, 15 aa, Artificial Sequence
  GFR-binding peptide
  MOD_RES (14)..(15): Xaa is C or S
FYLVSIANLKTPAXX

SEQ ID NO: 1641 - protein, 12 aa, Artificial Sequence
  GFR-binding peptide
YYLVSTASLQTP

SEQ ID NO: 1642 - protein, 10 aa, Artificial Sequence
  GFR-binding peptide
YYLMSTASLE

SEQ ID NO: 1643 - protein, 18 aa, Artificial Sequence
  GFR-binding peptide
  MOD_RES (14)..(14): Xaa is C or S
LYLVSIASLKTPAXTPKT

SEQ ID NO: 1644 - protein, 20 aa, Artificial Sequence
  GFR-binding peptide
  MOD_RES (16)..(16): Xaa is C or S
LYLVSIASLQVQTPRXQVNR

SEQ ID NO: 1645 - protein, 19 aa, Artificial Sequence
  GFR-binding peptide
  MOD_RES (14)..(15): Xaa is C or S
YYLMSTASLETPVXXAKPI

SEQ ID NO: 1646 - protein, 18 aa, Artificial Sequence
  GFR-binding peptide
  MOD_RES (14)..(15): Xaa is C or S
FYLVSIANLKTPAXXPKP

SEQ ID NO: 1647 - protein, 15 aa, Artificial Sequence
  GFR-binding peptide
LYLVSIASLQVQTPR

SEQ ID NO: 1648 - protein, 18 aa, Artificial Sequence
  GFR-binding peptide
  MOD_RES (14)..(15): Xaa is C or S
LYLISIASLDQSVXXPSA

SEQ ID NO: 1649 - protein, 17 aa, Artificial Sequence
  GFR-binding peptide
  MOD_RES (14)..(15): Xaa is C or S
LYLVSIASLQTPAXXPK

SEQ ID NO: 1650 - protein, 9 aa, Artificial Sequence
  GFR-binding peptide
FYLISIANL

SEQ ID NO: 1651 - protein, 13 aa, Artificial Sequence
  GFR-binding peptide
FYLVSIANLKTPA

SEQ ID NO: 1652 - protein, 17 aa, Artificial Sequence
  GFR-binding peptide
  MOD_RES (14)..(15): Xaa is C or S
YYLVSTASLKTPVXXAK

SEQ ID NO: 1653 - protein, 17 aa, Artificial Sequence
  GFR-binding peptide
  MOD_RES (14)..(15): Xaa is C or S
KYLISIPSLDQSVXXPS

SEQ ID NO: 1654 - protein, 14 aa, Artificial Sequence
  GFR-binding peptide
  MOD_RES (14)..(14): Xaa is C or S
FYLISIANLAQPVX

SEQ ID NO: 1655 - protein, 17 aa, Artificial Sequence
  GFR-binding peptide
  MOD_RES (14)..(15): Xaa is C or S
LYLVSIASLKTPAXXAK

SEQ ID NO: 1656 - protein, 10 aa, Artificial Sequence
  GFR-binding peptide
LYLVSIASLQ

SEQ ID NO: 1657 - protein, 15 aa, Artificial Sequence
  GFR-binding peptide
  MOD_RES (14)..(15): Xaa is C or S
KYLVSIPSLKTPAXX

SEQ ID NO: 1658 - protein, 11 aa, Artificial Sequence
  GFR-binding peptide
LYLVSIASLQV

SEQ ID NO: 1659 - protein, 12 aa, Artificial Sequence
  GFR-binding peptide
LYLVSIASLQVQ

SEQ ID NO: 1660 - protein, 14 aa, Artificial Sequence
  GFR-binding peptide
  MOD_RES (14)..(14): Xaa is C or S
FYLVSIANLQTPAX

SEQ ID NO: 1661 - protein, 16 aa, Artificial Sequence
  GFR-binding peptide
  MOD_RES (14)..(15): Xaa is C or S
KYLVSIPSLKTPAXXP

SEQ ID NO: 1662 - protein, 14 aa, Artificial Sequence
  GFR-binding peptide
  MOD_RES (14)..(14): Xaa is C or S
YYLVSTASLKTPAX

SEQ ID NO: 1663 - protein, 19 aa, Artificial Sequence
  GFR-binding peptide
  MOD_RES (14)..(15): Xaa is C or S
KYLISIPSLAQPVXXPAAS

SEQ ID NO: 1664 - protein, 15 aa, Artificial Sequence
  GFR-binding peptide
  MOD_RES (14)..(15): Xaa is C or S
LYLMSIASLETPVXX

SEQ ID NO: 1665 - protein, 19 aa, Artificial Sequence
  GFR-binding peptide
  MOD_RES (14)..(15): Xaa is C or S
FYLISIANLAQPVXXPAAS

SEQ ID NO: 1666 - protein, 13 aa, Artificial Sequence
  GFR-binding peptide
KYLISIPSLDQPV

SEQ ID NO: 1667 - protein, 19 aa, Artificial Sequence
  GFR-binding peptide
  MOD_RES (14)..(15): Xaa is C or S
KYLMSIPSLETPVXXAKPI

SEQ ID NO: 1668 - protein, 10 aa, Artificial Sequence
  GFR-binding peptide
YYLVSTASLQ

SEQ ID NO: 1669 - protein, 19 aa, Artificial Sequence
  GFR-binding peptide
  MOD_RES (16)..(16): Xaa is C or S
YYLVSTASLQVQTPRXQVN

SEQ ID NO: 1670 - protein, 8 aa, Artificial Sequence
  GFR-binding peptide
KYLVSIPS

SEQ ID NO: 1671 - protein, 14 aa, Artificial Sequence
  GFR-binding peptide
  MOD_RES (14)..(14): Xaa is C or S
KYLVSIPSLQTPAX

SEQ ID NO: 1672 - protein, 12 aa, Artificial Sequence
  GFR-binding peptide
FYLMSIANLETP

SEQ ID NO: 1673 - protein, 15 aa, Artificial Sequence
  GFR-binding peptide
  MOD_RES (14)..(14): Xaa is C or S
FYLVSIANLKTPAXT

SEQ ID NO: 1674 - protein, 20 aa, Artificial Sequence
  GFR-binding peptide
  MOD_RES (14)..(14): Xaa is C or S
FYLVSIANLKTPAXTPKTVH

SEQ ID NO: 1675 - protein, 17 aa, Artificial Sequence
  GFR-binding peptide
  MOD_RES (14)..(15): Xaa is C or S
YYLISTASLDQPVXXPS

SEQ ID NO: 1676 - protein, 12 aa, Artificial Sequence
  GFR-binding peptide
YYLVSTASLQVQ

SEQ ID NO: 1677 - protein, 16 aa, Artificial Sequence
  GFR-binding peptide
  MOD_RES (14)..(15): Xaa is C or S
KYLMSIPSLETPVXXA

SEQ ID NO: 1678 - protein, 19 aa, Artificial Sequence
  GFR-binding peptide
  MOD_RES (16)..(16): Xaa is C or S
LYLVSIASLQVQTPRXQVN

SEQ ID NO: 1679 - protein, 15 aa, Artificial Sequence
  GFR-binding peptide
YYLVSTASLQVQTPR

SEQ ID NO: 1680 - protein, 14 aa, Artificial Sequence
  GFR-binding peptide
YYLVSTASLQVQTP

SEQ ID NO: 1681 - protein, 16 aa, Artificial Sequence
  GFR-binding peptide
  MOD_RES (14)..(15): Xaa is C or S
FYLVSIANLKTPAXXP

SEQ ID NO: 1682 - protein, 9 aa, Artificial Sequence
  GFR-binding peptide
YYLISTASL

SEQ ID NO: 1683 - protein, 15 aa, Artificial Sequence
  GFR-binding peptide
  MOD_RES (14)..(15): Xaa is C or S
KYLVSIPSLKTPVXX

SEQ ID NO: 1684 - protein, 18 aa, Artificial Sequence
  GFR-binding peptide
  MOD_RES (14)..(14): Xaa is C or S
YYLVSTASLKTPAXTPKT

SEQ ID NO: 1685 - protein, 17 aa, Artificial Sequence
  GFR-binding peptide
  MOD_RES (14)..(15): Xaa is C or S
YYLMSTASLETPVXXAK

SEQ ID NO: 1686 - protein, 13 aa, Artificial Sequence
  GFR-binding peptide
KYLMSIPSLETPV

SEQ ID NO: 1687 - protein, 16 aa, Artificial Sequence
  GFR-binding peptide
  MOD_RES (16)..(16): Xaa is C or S
KYLVSIPSLQVQTPRX

SEQ ID NO: 1688 - protein, 13 aa, Artificial Sequence
  GFR-binding peptide
FYLVSIANLKTPV

SEQ ID NO: 1689 - protein, 14 aa, Artificial Sequence
  GFR-binding peptide
  MOD_RES (14)..(14): Xaa is C or S
KYLISIPSLDQSVX

SEQ ID NO: 1690 - protein, 19 aa, Artificial Sequence
  GFR-binding peptide
  MOD_RES (14)..(15): Xaa is C or S
FYLVSIANLKTPAXXAKPV

SEQ ID NO: 1691 - protein, 12 aa, Artificial Sequence
  GFR-binding peptide
FYLISIANLDQP

SEQ ID NO: 1692 - protein, 14 aa, Artificial Sequence
  GFR-binding peptide
  MOD_RES (14)..(14): Xaa is C or S
LYLVSIASLKTPAX

SEQ ID NO: 1693 - protein, 16 aa, Artificial Sequence
  GFR-binding peptide
  MOD_RES (16)..(16): Xaa is C or S
FYLVSIANLQVQTPRX

SEQ ID NO: 1694 - protein, 19 aa, Artificial Sequence
  GFR-binding peptide
  MOD_RES (14)..(15): Xaa is C or S
LYLVSIASLKTPAXXPKPV

SEQ ID NO: 1695 - protein, 19 aa, Artificial Sequence
  GFR-binding peptide
  MOD_RES (14)..(15): Xaa is C or S
FYLMSIANLETPVXXAKPI

SEQ ID NO: 1696 - protein, 17 aa, Artificial Sequence
  GFR-binding peptide
  MOD_RES (14)..(15): Xaa is C or S
LYLISIASLDQPVXXPS

SEQ ID NO: 1697 - protein, 14 aa, Artificial Sequence
  GFR-binding peptide
  MOD_RES (14)..(14): Xaa is C or S
YYLVSTASLKTPVX

SEQ ID NO: 1698 - protein, 20 aa, Artificial Sequence
  GFR-binding peptide
  MOD_RES (14)..(15): Xaa is C or S
KYLMSIPSLETPVXXAKPIS

SEQ ID NO: 1699 - protein, 13 aa, Artificial Sequence
  GFR-binding peptide
KYLVSIPSLKTPV

SEQ ID NO: 1700 - protein, 19 aa, Artificial Sequence
  GFR-binding peptide
  MOD_RES (14)..(15): Xaa is C or S
FYLISIANLDQPVXXPSAS

SEQ ID NO: 1701 - protein, 20 aa, Artificial Sequence
  GFR-binding peptide
  MOD_RES (14)..(15): Xaa is C or S
FYLMSIANLETPVXXAKPIS

SEQ ID NO: 1702 - protein, 19 aa, Artificial Sequence
  GFR-binding peptide
  MOD_RES (14)..(15): Xaa is C or S
LYLVSIASLKTPVXXAKGV

SEQ ID NO: 1703 - protein, 19 aa, Artificial Sequence
  GFR-binding peptide
  MOD_RES (14)..(15): Xaa is C or S
KYLVSIPSLKTPAXXAKPV

SEQ ID NO: 1704 - protein, 16 aa, Artificial Sequence
  GFR-binding peptide
  MOD_RES (14)..(15): Xaa is C or S
FYLMSIANLETPVXXA

SEQ ID NO: 1705 - protein, 17 aa, Artificial Sequence
  GFR-binding peptide
  MOD_RES (14)..(15): Xaa is C or S
YYLISTASLAQPVXXPA

SEQ ID NO: 1706 - protein, 15 aa, Artificial Sequence
  GFR-binding peptide
  MOD_RES (14)..(15): Xaa is C or S
LYLISIASLDQPVXX

SEQ ID NO: 1707 - protein, 10 aa, Artificial Sequence
  GFR-binding peptide
LYLISIASLD

SEQ ID NO: 1708 - protein, 19 aa, Artificial Sequence
  GFR-binding peptide
  MOD_RES (14)..(15): Xaa is C or S
KYLISIPSLDQPVXXPSAS

SEQ ID NO: 1709 - protein, 17 aa, Artificial Sequence
  GFR-binding peptide
  MOD_RES (14)..(15): Xaa is C or S
LYLVSIASLKTPVXXAK

SEQ ID NO: 1710 - protein, 9 aa, Artificial Sequence
  GFR-binding peptide
FYLMSIANL

SEQ ID NO: 1711 - protein, 20 aa, Artificial Sequence
  GFR-binding peptide
  MOD_RES (14)..(15): Xaa is C or S
LYLVSIASLKTPAXXAKPVA

SEQ ID NO: 1712 - protein, 9 aa, Artificial Sequence
  GFR-binding peptide
FYLVSIANL

SEQ ID NO: 1713 - protein, 13 aa, Artificial Sequence
  GFR-binding peptide
LYLMSIASLETPV

SEQ ID NO: 1714 - protein, 10 aa, Artificial Sequence
  GFR-binding peptide
YYLISTASLD

SEQ ID NO: 1715 - protein, 16 aa, Artificial Sequence
  GFR-binding peptide
  MOD_RES (14)..(15): Xaa is C or S
FYLVSIANLKTPAXXA

SEQ ID NO: 1716 - protein, 16 aa, Artificial Sequence
  GFR-binding peptide
  MOD_RES (14)..(14): Xaa is C or S
YYLVSTASLKTPAXTP

SEQ ID NO: 1717 - protein, 11 aa, Artificial Sequence
  GFR-binding peptide
YYLVSTASLQT

SEQ ID NO: 1718 - protein, 17 aa, Artificial Sequence
  GFR-binding peptide
  MOD_RES (14)..(15): Xaa is C or S
LYLISIASLAQPVXXPA

SEQ ID NO: 1719 - protein, 15 aa, Artificial Sequence
  GFR-binding peptide
  MOD_RES (14)..(15): Xaa is C or S
LYLVSIASLKTPVXX

SEQ ID NO: 1720 - protein, 16 aa, Artificial Sequence
  GFR-binding peptide
  MOD_RES (14)..(14): Xaa is C or S
LYLVSIASLKTPAXTP

SEQ ID NO: 1721 - protein, 14 aa, Artificial Sequence
  GFR-binding peptide
  MOD_RES (14)..(14): Xaa is C or S
LYLISIASLDQSVX

SEQ ID NO: 1722 - protein, 15 aa, Artificial Sequence
  GFR-binding peptide
  MOD_RES (14)..(15): Xaa is C or S
FYLVSIANLKTPVXX

SEQ ID NO: 1723 - protein, 19 aa, Artificial Sequence
  GFR-binding peptide
  MOD_RES (14)..(15): Xaa is C or S
YYLVSTASLKTPVXXAKGV

SEQ ID NO: 1724 - protein, 9 aa, Artificial Sequence
  GFR-binding peptide
LYLVSIASL

SEQ ID NO: 1725 - protein, 16 aa, Artificial Sequence
  GFR-binding peptide
  MOD_RES (14)..(14): Xaa is C or S
FYLVSIANLKTPAXTP

SEQ ID NO: 1726 - protein, 11 aa, Artificial Sequence
  GFR-binding peptide
KYLVSIPSLQV

SEQ ID NO: 1727 - protein, 11 aa, Artificial Sequence
  GFR-binding peptide
LYLISIASLAQ

SEQ ID NO: 1728 - protein, 11 aa, Artificial Sequence
  GFR-binding peptide
KYLVSIPSLQT

SEQ ID NO: 1729 - protein, 19 aa, Artificial Sequence
  GFR-binding peptide
  MOD_RES (14)..(15): Xaa is C or S
FYLVSIANLQTPAXXPKPV

SEQ ID NO: 1730 - protein, 20 aa, Artificial Sequence
  GFR-binding peptide
  MOD_RES (14)..(15): Xaa is C or S
YYLISTASLDQPVXXPSASA

SEQ ID NO: 1731 - protein, 17 aa, Artificial Sequence
  GFR-binding peptide
  MOD_RES (14)..(15): Xaa is C or S
LYLMSIASLETPVXXAK

SEQ ID NO: 1732 - protein, 16 aa, Artificial Sequence
  GFR-binding peptide
  MOD_RES (14)..(15): Xaa is C or S
LYLISIASLDQPVXXP

SEQ ID NO: 1733 - protein, 17 aa, Artificial Sequence
  GFR-binding peptide
  MOD_RES (14)..(15): Xaa is C or S
YYLVSTASLKTPAXXPK

SEQ ID NO: 1734 - protein, 15 aa, Artificial Sequence
  GFR-binding peptide
  MOD_RES (14)..(15): Xaa is C or S
YYLVSTASLKTPVXX

SEQ ID NO: 1735 - protein, 20 aa, Artificial Sequence
  GFR-binding peptide
  MOD_RES (14)..(15): Xaa is C or S
LYLVSIASLKTPVXXAKGVK

SEQ ID NO: 1736 - protein, 19 aa, Artificial Sequence
  GFR-binding peptide
  MOD_RES (14)..(15): Xaa is C or S
KYLVSIPSLQTPAXXPKPV

SEQ ID NO: 1737 - protein, 11 aa, Artificial Sequence
  GFR-binding peptide
FYLVSIANLQT

SEQ ID NO: 1738 - protein, 20 aa, Artificial Sequence
  GFR-binding peptide
  MOD_RES (14)..(15): Xaa is C or S
LYLISIASLDQSVXXPSASA

SEQ ID NO: 1739 - protein, 19 aa, Artificial Sequence
  GFR-binding peptide
  MOD_RES (14)..(15): Xaa is C or S
FYLVSIANLKTPAXXPKPV

SEQ ID NO: 1740 - protein, 20 aa, Artificial Sequence
  GFR-binding peptide
  MOD_RES (14)..(15): Xaa is C or S
FYLVSIANLQTPAXXPKPVT

SEQ ID NO: 1741 - protein, 18 aa, Artificial Sequence
  GFR-binding peptide
  MOD_RES (14)..(15): Xaa is C or S
FYLISIANLAQPVXXPAA

SEQ ID NO: 1742 - protein, 16 aa, Artificial Sequence
  GFR-binding peptide
  MOD_RES (14)..(15): Xaa is C or S
KYLVSIPSLKTPAXXA

SEQ ID NO: 1743 - protein, 16 aa, Artificial Sequence
  GFR-binding peptide
  MOD_RES (14)..(14): Xaa is C or S
KYLVSIPSLKTPAXTP

SEQ ID NO: 1744 - protein, 15 aa, Artificial Sequence
  GFR-binding peptide
  MOD_RES (14)..(15): Xaa is C or S
FYLISIANLDQSVXX

SEQ ID NO: 1745 - protein, 19 aa, Artificial Sequence
  GFR-binding peptide
  MOD_RES (14)..(15): Xaa is C or S
KYLVSIPSLKTPAXXPKPV

SEQ ID NO: 1746 - protein, 9 aa, Artificial Sequence
  GFR-binding peptide
KYLVSIPSL

SEQ ID NO: 1747 - protein, 17 aa, Artificial Sequence
  GFR-binding peptide
  MOD_RES (14)..(14): Xaa is C or S
FYLVSIANLKTPAXTPK

SEQ ID NO: 1748 - protein, 17 aa, Artificial Sequence
  GFR-binding peptide
  MOD_RES (14)..(15): Xaa is C or S
KYLVSIPSLKTPVXXAK

SEQ ID NO: 1749 - protein, 13 aa, Artificial Sequence
  GFR-binding peptide
LYLVSIASLKTPV

SEQ ID NO: 1750 - protein, 17 aa, Artificial Sequence
  GFR-binding peptide
  MOD_RES (14)..(15): Xaa is C or S
YYLVSTASLKTPAXXAK

SEQ ID NO: 1751 - protein, 16 aa, Artificial Sequence
  GFR-binding peptide
  MOD_RES (14)..(15): Xaa is C or S
LYLVSIASLKTPAXXP

SEQ ID NO: 1752 - protein, 15 aa, Artificial Sequence
  GFR-binding peptide
  MOD_RES (14)..(15): Xaa is C or S
YYLISTASLDQPVXX

SEQ ID NO: 1753 - protein, 13 aa, Artificial Sequence
  GFR-binding peptide
YYLISTASLDQPV

SEQ ID NO: 1754 - protein, 18 aa, Artificial Sequence
  GFR-binding peptide
  MOD_RES (14)..(15): Xaa is C or S
YYLVSTASLKTPAXXAKP

SEQ ID NO: 1755 - protein, 12 aa, Artificial Sequence
  GFR-binding peptide
KYLVSIPSLQVQ

SEQ ID NO: 1756 - protein, 11 aa, Artificial Sequence
  GFR-binding peptide
FYLISIANLAQ

SEQ ID NO: 1757 - protein, 20 aa, Artificial Sequence
  GFR-binding peptide
  MOD_RES (14)..(15): Xaa is C or S
FYLISIANLDQSVXXPSASA

SEQ ID NO: 1758 - protein, 14 aa, Artificial Sequence
  GFR-binding peptide
LYLVSIASLQVQTP

SEQ ID NO: 1759 - protein, 10 aa, Artificial Sequence
  GFR-binding peptide
KYLVSIPSLQ

SEQ ID NO: 1760 - protein, 11 aa, Artificial Sequence
  GFR-binding peptide
LYLVSIASLQT

SEQ ID NO: 1761 - protein, 13 aa, Artificial Sequence
  GFR-binding peptide
FYLISIANLDQSV

SEQ ID NO: 1762 - protein, 14 aa, Artificial Sequence
  GFR-binding peptide
  MOD_RES (14)..(14): Xaa is C or S
LYLVSIASLQTPAX

SEQ ID NO: 1763 - protein, 11 aa, Artificial Sequence
  GFR-binding peptide
LYLISIASLDQ

SEQ ID NO: 1764 - protein, 16 aa, Artificial Sequence
  GFR-binding peptide
  MOD_RES (14)..(15): Xaa is C or S
KYLISIPSLDQPVXXP

SEQ ID NO: 1765 - protein, 15 aa, Artificial Sequence
  GFR-binding peptide
  MOD_RES (14)..(15): Xaa is C or S
KYLISIPSLDQSVXX

SEQ ID NO: 1766 - protein, 18 aa, Artificial Sequence
  GFR-binding peptide
  MOD_RES (14)..(15): Xaa is C or S
FYLISIANLDQPVXXPSA

SEQ ID NO: 1767 - protein, 11 aa, Artificial Sequence
  GFR-binding peptide
KYLISIPSLAQ

SEQ ID NO: 1768 - protein, 20 aa, Artificial Sequence
  GFR-binding peptide
  MOD_RES (14)..(15): Xaa is C or S
KYLISIPSLDQSVXXPSASA

SEQ ID NO: 1769 - protein, 15 aa, Artificial Sequence
  GFR-binding peptide
  MOD_RES (14)..(15): Xaa is C or S
YYLMSTASLETPVXX

SEQ ID NO: 1770 - protein, 17 aa, Artificial Sequence
  GFR-binding peptide
  MOD_RES (14)..(14): Xaa is C or S
KYLVSIPSLKTPAXTPK

SEQ ID NO: 1771 - protein, 14 aa, Artificial Sequence
  GFR-binding peptide
  MOD_RES (14)..(14): Xaa is C or S
YYLISTASLDQSVX

SEQ ID NO: 1772 - protein, 13 aa, Artificial Sequence
  GFR-binding peptide
KYLISIPSLDQSV

SEQ ID NO: 1773 - protein, 16 aa, Artificial Sequence
  GFR-binding peptide
  MOD_RES (14)..(15): Xaa is C or S
FYLISIANLDQPVXXP

SEQ ID NO: 1774 - protein, 13 aa, Artificial Sequence
  GFR-binding peptide
YYLMSTASLETPV

SEQ ID NO: 1775 - protein, 14 aa, Artificial Sequence
  GFR-binding peptide
  MOD_RES (14)..(14): Xaa is C or S
YYLVSTASLQTPAX

SEQ ID NO: 1776 - protein, 9 aa, Artificial Sequence
  GFR-binding peptide
KYLISIPSL

SEQ ID NO: 1777 - protein, 16 aa, Artificial Sequence
  GFR-binding peptide
  MOD_RES (16)..(16): Xaa is C or S
YYLVSTASLQVQTPRX

SEQ ID NO: 1778 - protein, 15 aa, Artificial Sequence
  GFR-binding peptide
  MOD_RES (14)..(15): Xaa is C or S
KYLISIPSLAQPVXX

SEQ ID NO: 1779 - protein, 16 aa, Artificial Sequence
  GFR-binding peptide
  MOD_RES (14)..(15): Xaa is C or S
KYLVSIPSLQTPAXXP

SEQ ID NO: 1780 - protein, 10 aa, Artificial Sequence
  GFR-binding peptide
FYLVSIANLQ

SEQ ID NO: 1781 - protein, 12 aa, Artificial Sequence
  GFR-binding peptide
FYLVSIANLQVQ

SEQ ID NO: 1782 - protein, 16 aa, Artificial Sequence
  GFR-binding peptide
  MOD_RES (14)..(15): Xaa is C or S
YYLMSTASLETPVXXA

SEQ ID NO: 1783 - protein, 19 aa, Artificial Sequence
  GFR-binding peptide
  MOD_RES (14)..(15): Xaa is C or S
FYLISIANLDQSVXXPSAS

SEQ ID NO: 1784 - protein, 17 aa, Artificial Sequence
  GFR-binding peptide
  MOD_RES (14)..(14): Xaa is C or S
YYLVSTASLKTPAXTPK

SEQ ID NO: 1785 - protein, 18 aa, Artificial Sequence
  GFR-binding peptide
  MOD_RES (14)..(15): Xaa is C or S
KYLISIPSLAQPVXXPAA

SEQ ID NO: 1786 - protein, 14 aa, Artificial Sequence
  GFR-binding peptide
KYLVSIPSLQVQTP

SEQ ID NO: 1787 - protein, 13 aa, Artificial Sequence
  GFR-binding peptide
YYLVSTASLKTPV

SEQ ID NO: 1788 - protein, 20 aa, Artificial Sequence
  GFR-binding peptide
  MOD_RES (14)..(15): Xaa is C or S
LYLVSIASLKTPAXXPKPVY

SEQ ID NO: 1789 - protein, 16 aa, Artificial Sequence
  GFR-binding peptide
  MOD_RES (14)..(15): Xaa is C or S
FYLISIANLAQPVXXP

SEQ ID NO: 1790 - protein, 10 aa, Artificial Sequence
  GFR-binding peptide
LYLVSIASLK

SEQ ID NO: 1791 - protein, 20 aa, Artificial Sequence
  GFR-binding peptide
  MOD_RES (14)..(15): Xaa is C or S
LYLMSIASLETPVXXAKPIS

SEQ ID NO: 1792 - protein, 9 aa, Artificial Sequence
  GFR-binding peptide
LYLMSIASL

SEQ ID NO: 1793 - protein, 14 aa, Artificial Sequence
  GFR-binding peptide
  MOD_RES (14)..(14): Xaa is C or S
KYLVSIPSLKTPAX

SEQ ID NO: 1794 - protein, 15 aa, Artificial Sequence
  GFR-binding peptide
  MOD_RES (14)..(15): Xaa is C or S
LYLISIASLDQSVXX

SEQ ID NO: 1795 - protein, 15 aa, Artificial Sequence
  GFR-binding peptide
  MOD_RES (14)..(15): Xaa is C or S
YYLVSTASLKTPAXX

SEQ ID NO: 1796 - protein, 10 aa, Artificial Sequence
  GFR-binding peptide
LYLMSIASLE

SEQ ID NO: 1797 - protein, 18 aa, Artificial Sequence
  GFR-binding peptide
  MOD_RES (14)..(15): Xaa is C or S
KYLVSIPSLQTPAXXPKP

SEQ ID NO: 1798 - protein, 13 aa, Artificial Sequence
  GFR-binding peptide
KYLVSIPSLQTPA

SEQ ID NO: 1799 - protein, 18 aa, Artificial Sequence
  GFR-binding peptide
  MOD_RES (14)..(15): Xaa is C or S
YYLISTASLDQSVXXPSA

SEQ ID NO: 1800 - protein, 10 aa, Artificial Sequence
  GFR-binding peptide
KYLISIPSLA

SEQ ID NO: 1801 - protein, 19 aa, Artificial Sequence
  GFR-binding peptide
  MOD_RES (14)..(15): Xaa is C or S
LYLMSIASLETPVXXAKPI

SEQ ID NO: 1802 - protein, 18 aa, Artificial Sequence
  GFR-binding peptide
  MOD_RES (14)..(15): Xaa is C or S
YYLMSTASLETPVXXAKP

SEQ ID NO: 1803 - protein, 17 aa, Artificial Sequence
  GFR-binding peptide
  MOD_RES (14)..(15): Xaa is C or S
KYLVSIPSLKTPAXXAK

SEQ ID NO: 1804 - protein, 12 aa, Artificial Sequence
  GFR-binding peptide
YYLISTASLAQP

SEQ ID NO: 1805 - protein, 14 aa, Artificial Sequence
  GFR-binding peptide
  MOD_RES (14)..(14): Xaa is C or S
YYLISTASLAQPVX

SEQ ID NO: 1806 - protein, 13 aa, Artificial Sequence
  GFR-binding peptide
YYLVSTASLKTPA

SEQ ID NO: 1807 - protein, 12 aa, Artificial Sequence
  GFR-binding peptide
KYLISIPSLDQP

SEQ ID NO: 1808 - protein, 13 aa, Artificial Sequence
  GFR-binding peptide
KYLISIPSLAQPV

SEQ ID NO: 1809 - protein, 20 aa, Artificial Sequence
  GFR-binding peptide
  MOD_RES (14)..(15): Xaa is C or S
YYLISTASLAQPVXXPAASA

SEQ ID NO: 1810 - protein, 13 aa, Artificial Sequence
  GFR-binding peptide
YYLVSTASLQVQT

SEQ ID NO: 1811 - protein, 15 aa, Artificial Sequence
  GFR-binding peptide
  MOD_RES (14)..(15): Xaa is C or S
KYLVSIPSLQTPAXX

SEQ ID NO: 1812 - protein, 11 aa, Artificial Sequence
  GFR-binding peptide
YYLMSTASLET

SEQ ID NO: 1813 - protein, 19 aa, Artificial Sequence
  GFR-binding peptide
  MOD_RES (14)..(15): Xaa is C or S
LYLISIASLAQPVXXPAAS

SEQ ID NO: 1814 - protein, 15 aa, Artificial Sequence
  GFR-binding peptide
  MOD_RES (14)..(15): Xaa is C or S
FYLMSIANLETPVXX

SEQ ID NO: 1815 - protein, 18 aa, Artificial Sequence
  GFR-binding peptide
  MOD_RES (14)..(15): Xaa is C or S
YYLVSTASLKTPAXXPKP

SEQ ID NO: 1816 - protein, 14 aa, Artificial Sequence
  GFR-binding peptide
  MOD_RES (14)..(14): Xaa is C or S
KYLISIPSLDQPVX

SEQ ID NO: 1817 - protein, 20 aa, Artificial Sequence
  GFR-binding peptide
  MOD_RES (14)..(15): Xaa is C or S
LYLISIASLDQPVXXPSASA

SEQ ID NO: 1818 - protein, 19 aa, Artificial Sequence
  GFR-binding peptide
  MOD_RES (14)..(14): Xaa is C or S
KYLVSIPSLKTPAXTPKTV

SEQ ID NO: 1819 - protein, 15 aa, Artificial Sequence
  GFR-binding peptide
  MOD_RES (14)..(14): Xaa is C or S
LYLVSIASLKTPAXT

SEQ ID NO: 1820 - protein, 18 aa, Artificial Sequence
  GFR-binding peptide
  MOD_RES (14)..(15): Xaa is C or S
KYLVSIPSLKTPAXXAKP

SEQ ID NO: 1821 - protein, 12 aa, Artificial Sequence
  GFR-binding peptide
LYLVSIASLKTP

SEQ ID NO: 1822 - protein, 12 aa, Artificial Sequence
  GFR-binding peptide
FYLVSIANLQTP

SEQ ID NO: 1823 - protein, 15 aa, Artificial Sequence
  GFR-binding peptide
  MOD_RES (14)..(15): Xaa is C or S
KYLISIPSLDQPVXX

SEQ ID NO: 1824 - protein, 15 aa, Artificial Sequence
  GFR-binding peptide
KYLVSIPSLQVQTPR

SEQ ID NO: 1825 - protein, 17 aa, Artificial Sequence
  GFR-binding peptide
  MOD_RES (16)..(16): Xaa is C or S
FYLVSIANLQVQTPRXQ

SEQ ID NO: 1826 - protein, 13 aa, Artificial Sequence
  GFR-binding peptide
FYLMSIANLETPV

SEQ ID NO: 1827 - protein, 19 aa, Artificial Sequence
  GFR-binding peptide
  MOD_RES (14)..(15): Xaa is C or S
YYLVSTASLKTPAXXPKPV

SEQ ID NO: 1828 - protein, 20 aa, Artificial Sequence
  GFR-binding peptide
  MOD_RES (14)..(15): Xaa is C or S
KYLISIPSLAQPVXXPAASA

SEQ ID NO: 1829 - protein, 18 aa, Artificial Sequence
  GFR-binding peptide
  MOD_RES (14)..(15): Xaa is C or S
YYLVSTASLQTPAXXPKP

SEQ ID NO: 1830 - protein, 20 aa, Artificial Sequence
  GFR-binding peptide
  MOD_RES (14)..(15): Xaa is C or S
KYLMSIPSLETPVXXAKPIK

SEQ ID NO: 1831 - protein, 17 aa, Artificial Sequence
  GFR-binding peptide
  MOD_RES (14)..(15): Xaa is C or S
YYLVSTASLQTPAXXPK

SEQ ID NO: 1832 - protein, 16 aa, Artificial Sequence
  GFR-binding peptide
  MOD_RES (14)..(15): Xaa is C or S
KYLVSIPSLKTPVXXA

SEQ ID NO: 1833 - protein, 20 aa, Artificial Sequence
  GFR-binding peptide
  MOD_RES (14)..(15): Xaa is C or S
YYLISTASLDQSVXXPSASA

SEQ ID NO: 1834 - protein, 19 aa, Artificial Sequence
  GFR-binding peptide
  MOD_RES (14)..(15): Xaa is C or S
KYLVSIPSLKTPVXXAKGV

SEQ ID NO: 1835 - protein, 16 aa, Artificial Sequence
  GFR-binding peptide
  MOD_RES (14)..(15): Xaa is C or S
YYLVSTASLKTPVXXA

SEQ ID NO: 1836 - protein, 12 aa, Artificial Sequence
  GFR-binding peptide
KYLISIPSLDQS

SEQ ID NO: 1837 - protein, 8 aa, Artificial Sequence
  GFR-binding peptide
YYLVSTAS

SEQ ID NO: 1838 - protein, 20 aa, Artificial Sequence
  GFR-binding peptide
  MOD_RES (14)..(15): Xaa is C or S
YYLMSTASLETPVXXAKPIK

SEQ ID NO: 1839 - protein, 17 aa, Artificial Sequence
  GFR-binding peptide
  MOD_RES (14)..(15): Xaa is C or S
KYLVSIPSLKTPAXXPK

SEQ ID NO: 1840 - protein, 17 aa, Artificial Sequence
  GFR-binding peptide
  MOD_RES (14)..(15): Xaa is C or S
KYLVSIPSLQTPAXXPK

SEQ ID NO: 1841 - protein, 12 aa, Artificial Sequence
  GFR-binding peptide
YYLISTASLDQP

SEQ ID NO: 1842 - protein, 16 aa, Artificial Sequence
  GFR-binding peptide
  MOD_RES (14)..(15): Xaa is C or S
FYLISIANLDQSVXXP

SEQ ID NO: 1843 - protein, 14 aa, Artificial Sequence
  GFR-binding peptide
  MOD_RES (14)..(14): Xaa is C or S
YYLISTASLDQPVX

SEQ ID NO: 1844 - protein, 14 aa, Artificial Sequence
  GFR-binding peptide
  MOD_RES (14)..(14): Xaa is C or S
KYLISIPSLAQPVX

SEQ ID NO: 1845 - protein, 18 aa, Artificial Sequence
  GFR-binding peptide
  MOD_RES (16)..(16): Xaa is C or S
KYLVSIPSLQVQTPRXQV

SEQ ID NO: 1846 - protein, 14 aa, Artificial Sequence
  GFR-binding peptide
  MOD_RES (14)..(14): Xaa is C or S
FYLMSIANLETPVX

SEQ ID NO: 1847 - protein, 13 aa, Artificial Sequence
  GFR-binding peptide
KYLVSIPSLQVQT

SEQ ID NO: 1848 - protein, 17 aa, Artificial Sequence
  GFR-binding peptide
  MOD_RES (14)..(15): Xaa is C or S
LYLISIASLDQSVXXPS

SEQ ID NO: 1849 - protein, 9 aa, Artificial Sequence
  GFR-binding peptide
YYLVSTASL

SEQ ID NO: 1850 - protein, 20 aa, Artificial Sequence
  GFR-binding peptide
  MOD_RES (14)..(15): Xaa is C or S
FYLISIANLDQPVXXPSASA

SEQ ID NO: 1851 - protein, 18 aa, Artificial Sequence
  GFR-binding peptide
  MOD_RES (14)..(14): Xaa is C or S
KYLVSIPSLKTPAXTPKT

SEQ ID NO: 1852 - protein, 12 aa, Artificial Sequence
  GFR-binding peptide
LYLVSIASLQTP

SEQ ID NO: 1853 - protein, 11 aa, Artificial Sequence
  GFR-binding peptide
YYLVSTASLKT

SEQ ID NO: 1854 - protein, 18 aa, Artificial Sequence
  GFR-binding peptide
  MOD_RES (14)..(15): Xaa is C or S
KYLVSIPSLKTPAXXPKP

SEQ ID NO: 1855 - protein, 14 aa, Artificial Sequence
  GFR-binding peptide
  MOD_RES (14)..(14): Xaa is C or S
FYLVSIANLKTPVX

SEQ ID NO: 1856 - protein, 10 aa, Artificial Sequence
  GFR-binding peptide
KYLISIPSLD

SEQ ID NO: 1857 - protein, 15 aa, Artificial Sequence
  GFR-binding peptide
  MOD_RES (14)..(15): Xaa is C or S
YYLVSTASLQTPAXX

SEQ ID NO: 1858 - protein, 14 aa, Artificial Sequence
  GFR-binding peptide
  MOD_RES (14)..(14): Xaa is C or S
LYLVSIASLKTPVX

SEQ ID NO: 1859 - protein, 19 aa, Artificial Sequence
  GFR-binding peptide
  MOD_RES (14)..(15): Xaa is C or S
YYLVSTASLKTPAXXAKPV

SEQ ID NO: 1860 - protein, 13 aa, Artificial Sequence
  GFR-binding peptide
KYLVSIPSLKTPA

SEQ ID NO: 1861 - protein, 19 aa, Artificial Sequence
  GFR-binding peptide
  MOD_RES (14)..(14): Xaa is C or S
YYLVSTASLKTPAXTPKTV

SEQ ID NO: 1862 - protein, 16 aa, Artificial Sequence
  GFR-binding peptide
  MOD_RES (14)..(15): Xaa is C or S
LYLISIASLDQSVXXP

SEQ ID NO: 1863 - protein, 13 aa, Artificial Sequence
  GFR-binding peptide
YYLVSTASLQTPA

SEQ ID NO: 1864 - protein, 19 aa, Artificial Sequence
  GFR-binding peptide
  MOD_RES (16)..(16): Xaa is C or S
KYLVSIPSLQVQTPRXQVN

SEQ ID NO: 1865 - protein, 12 aa, Artificial Sequence
  GFR-binding peptide
FYLVSIANLKTP

SEQ ID NO: 1866 - protein, 17 aa, Artificial Sequence
  GFR-binding peptide
  MOD_RES (14)..(15): Xaa is C or S
FYLISIANLDQSVXXPS

SEQ ID NO: 1867 - protein, 12 aa, Artificial Sequence
  GFR-binding peptide
LYLMSIASLETP

SEQ ID NO: 1868 - protein, 11 aa, Artificial Sequence
  GFR-binding peptide
YYLVSTASLQV

SEQ ID NO: 1869 - protein, 14 aa, Artificial Sequence
  GFR-binding peptide
  MOD_RES (14)..(14): Xaa is C or S
LYLMSIASLETPVX

SEQ ID NO: 1870 - protein, 13 aa, Artificial Sequence
  GFR-binding peptide
APTKLSPISVLFI

SEQ ID NO: 1871 - protein, 13 aa, Artificial Sequence
  GFR-binding peptide
APTQLSAISVLYL

SEQ ID NO: 1872 - protein, 14 aa, Artificial Sequence
  GFR-binding peptide
  MOD_RES (1)..(1): Xaa is C or S
XVPQALSPISILFI

SEQ ID NO: 1873 - protein, 20 aa, Artificial Sequence
  GFR-binding peptide
  MOD_RES (7)..(7): Xaa is C or S
HVTKPTXAPTKLSPISVLFI

SEQ ID NO: 1874 - protein, 11 aa, Artificial Sequence
  GFR-binding peptide
TQLEPLTVLYY

SEQ ID NO: 1875 - protein, 13 aa, Artificial Sequence
  GFR-binding peptide
VPQDLEPLPIVYY

SEQ ID NO: 1876 - protein, 19 aa, Artificial Sequence
  GFR-binding peptide
  MOD_RES (5)..(6): Xaa is C or S
VPKPXXAPTKLEPLTVLYY

SEQ ID NO: 1877 - protein, 19 aa, Artificial Sequence
  GFR-binding peptide
  MOD_RES (5)..(6): Xaa is C or S
SASPXXVSQDLSAISILYL

SEQ ID NO: 1878 - protein, 17 aa, Artificial Sequence
  GFR-binding peptide
  MOD_RES (3)..(4): Xaa is C or S
KPXXAPTQLEPLTVLYY

SEQ ID NO: 1879 - protein, 18 aa, Artificial Sequence
  GFR-binding peptide
  MOD_RES (5)..(5): Xaa is C or S
TKPTXAPTKLEPLTVLYY

SEQ ID NO: 1880 - protein, 11 aa, Artificial Sequence
  GFR-binding peptide
QDLNAISILYF

SEQ ID NO: 1881 - protein, 16 aa, Artificial Sequence
  GFR-binding peptide
  MOD_RES (2)..(3): Xaa is C or S
PXXAPTKLEPLPVVYY

SEQ ID NO: 1882 - protein, 13 aa, Artificial Sequence
  GFR-binding peptide
VPTRLSAISILYL

SEQ ID NO: 1883 - protein, 16 aa, Artificial Sequence
  GFR-binding peptide
  MOD_RES (3)..(3): Xaa is C or S
PTXAPTKLEPLTVLYY

SEQ ID NO: 1884 - protein, 13 aa, Artificial Sequence
  GFR-binding peptide
VPQALSAISILYL

SEQ ID NO: 1885 - protein, 10 aa, Artificial Sequence
  GFR-binding peptide
ALSAISILYL

SEQ ID NO: 1886 - protein, 19 aa, Artificial Sequence
  GFR-binding peptide
  MOD_RES (5)..(6): Xaa is C or S
SASPXXVPQDLSPISILFI

SEQ ID NO: 1887 - protein, 9 aa, Artificial Sequence
  GFR-binding peptide
LEPLPVVYY

SEQ ID NO: 1888 - protein, 20 aa, Artificial Sequence
  GFR-binding peptide
  MOD_RES (6)..(7): Xaa is C or S
YVPKPXXAPTKLSPISVLFI

SEQ ID NO: 1889 - protein, 16 aa, Artificial Sequence
  GFR-binding peptide
  MOD_RES (2)..(3): Xaa is C or S
AXXVPTELSPISMLFI

SEQ ID NO: 1890 - protein, 20 aa, Artificial Sequence
  GFR-binding peptide
  MOD_RES (6)..(7): Xaa is C or S
SIPKAXXVPTELSPISMLFI

SEQ ID NO: 1891 - protein, 10 aa, Artificial Sequence
  GFR-binding peptide
DLEPLPIVYY

SEQ ID NO: 1892 - protein, 13 aa, Artificial Sequence
  GFR-binding peptide
VPTELEPLTMLYY

SEQ ID NO: 1893 - protein, 11 aa, Artificial Sequence
  GFR-binding peptide
TRLEPLPIVYY

SEQ ID NO: 1894 - protein, 19 aa, Artificial Sequence
  GFR-binding peptide
  MOD_RES (5)..(6): Xaa is C or S
VPKPXXAPTKLEPLPVVYY

SEQ ID NO: 1895 - protein, 15 aa, Artificial Sequence
  GFR-binding peptide
  MOD_RES (1)..(2): Xaa is C or S
XXVPTELEPLTMLYY

SEQ ID NO: 1896 - protein, 9 aa, Artificial Sequence
  GFR-binding peptide
LSPISMLFI

SEQ ID NO: 1897 - protein, 15 aa, Artificial Sequence
  GFR-binding peptide
  MOD_RES (1)..(2): Xaa is C or S
XXVSQDLSPISILFI

SEQ ID NO: 1898 - protein, 16 aa, Artificial Sequence
  GFR-binding peptide
  MOD_RES (2)..(3): Xaa is C or S
PXXVPQDLEPLPIVYY

SEQ ID NO: 1899 - protein, 11 aa, Artificial Sequence
  GFR-binding peptide
TQLEPLPVVYY

SEQ ID NO: 1900 - protein, 10 aa, Artificial Sequence
  GFR-binding peptide
ELNAISMLYF

SEQ ID NO: 1901 - protein, 17 aa, Artificial Sequence
  GFR-binding peptide
  MOD_RES (4)..(4): Xaa is C or S
KPTXAPTKLSPISVLFI

SEQ ID NO: 1902 - protein, 20 aa, Artificial Sequence
  GFR-binding peptide
  MOD_RES (6)..(7): Xaa is C or S
STPPTXXVPTRLSAISILYL

SEQ ID NO: 1903 - protein, 17 aa, Artificial Sequence
  GFR-binding peptide
  MOD_RES (3)..(4): Xaa is C or S
KPXXAPTQLEPLPVVYY

SEQ ID NO: 1904 - protein, 12 aa, Artificial Sequence
  GFR-binding peptide
SQDLSAISILYL

SEQ ID NO: 1905 - protein, 14 aa, Artificial Sequence
  GFR-binding peptide
  MOD_RES (1)..(1): Xaa is C or S
XAPTQLEPLPVVYY

SEQ ID NO: 1906 - protein, 17 aa, Artificial Sequence
  GFR-binding peptide
  MOD_RES (4)..(4): Xaa is C or S
KPTXAPTKLEPLPVVYY

SEQ ID NO: 1907 - protein, 19 aa, Artificial Sequence
  GFR-binding peptide
  MOD_RES (5)..(6): Xaa is C or S
IPKAXXVPTELSPISMLFI

SEQ ID NO: 1908 - protein, 10 aa, Artificial Sequence
  GFR-binding peptide
RLEPLTILYY

SEQ ID NO: 1909 - protein, 19 aa, Artificial Sequence
  GFR-binding peptide
  MOD_RES (5)..(6): Xaa is C or S
TPPTXXVPTRLSAISILYL

SEQ ID NO: 1910 - protein, 16 aa, Artificial Sequence
  GFR-binding peptide
  MOD_RES (3)..(3): Xaa is C or S
PTXAPTKLEPLPVVYY

SEQ ID NO: 1911 - protein, 17 aa, Artificial Sequence
  GFR-binding peptide
  MOD_RES (3)..(4): Xaa is C or S
SPXXVSQDLEPLPIVYY

SEQ ID NO: 1912 - protein, 16 aa, Artificial Sequence
  GFR-binding peptide
  MOD_RES (2)..(3): Xaa is C or S
PXXAPTKLEPLTVLYY

SEQ ID NO: 1913 - protein, 19 aa, Artificial Sequence
  GFR-binding peptide
  MOD_RES (5)..(6): Xaa is C or S
SAAPXXVPQALSPISILFI

SEQ ID NO: 1914 - protein, 14 aa, Artificial Sequence
  GFR-binding peptide
  MOD_RES (1)..(1): Xaa is C or S
XVPTRLEPLPIVYY

SEQ ID NO: 1915 - protein, 20 aa, Artificial Sequence
  GFR-binding peptide
  MOD_RES (6)..(7): Xaa is C or S
KIPKAXXVPTELEPLTMLYY

SEQ ID NO: 1916 - protein, 16 aa, Artificial Sequence
  GFR-binding peptide
  MOD_RES (2)..(3): Xaa is C or S
PXXVPQALSAISILYL

SEQ ID NO: 1917 - protein, 16 aa, Artificial Sequence
  GFR-binding peptide
  MOD_RES (2)..(3): Xaa is C or S
PXXAPTQLSAISVLYL

SEQ ID NO: 1918 - protein, 15 aa, Artificial Sequence
  GFR-binding peptide
  MOD_RES (1)..(2): Xaa is C or S
XXAPTKLEPLPVVYY

SEQ ID NO: 1919 - protein, 13 aa, Artificial Sequence
  GFR-binding peptide
VPQDLSPISILFI

SEQ ID NO: 1920 - protein, 15 aa, Artificial Sequence
  GFR-binding peptide
  MOD_RES (2)..(2): Xaa is C or S
TXAPTKLSPISVLFI

SEQ ID NO: 1921 - protein, 13 aa, Artificial Sequence
  GFR-binding peptide
APTKLEPLPVVYY

SEQ ID NO: 1922 - protein, 13 aa, Artificial Sequence
  GFR-binding peptide
VPTELSPISMLFI

SEQ ID NO: 1923 - protein, 10 aa, Artificial Sequence
  GFR-binding peptide
RLEPLPIVYY

SEQ ID NO: 1924 - protein, 20 aa, Artificial Sequence
  GFR-binding peptide
  MOD_RES (6)..(7): Xaa is C or S
SIPKAXXVPTELEPLPMVYY

SEQ ID NO: 1925 - protein, 16 aa, Artificial Sequence
  GFR-binding peptide
  MOD_RES (2)..(3): Xaa is C or S
TXXVPTRLEPLTILYY

SEQ ID NO: 1926 - protein, 12 aa, Artificial Sequence
  GFR-binding peptide
PTRLSAISILYL

SEQ ID NO: 1927 - protein, 14 aa, Artificial Sequence
  GFR-binding peptide
  MOD_RES (1)..(1): Xaa is C or S
XVPTRLEPLTILYY

SEQ ID NO: 1928 - protein, 14 aa, Artificial Sequence
  GFR-binding peptide
  MOD_RES (1)..(1): Xaa is C or S
XAPTKLEPLTVLYY

SEQ ID NO: 1929 - protein, 16 aa, Artificial Sequence
  GFR-binding peptide
  MOD_RES (3)..(3): Xaa is C or S
PTXAPTKLSPISVLFI

SEQ ID NO: 1930 - protein, 17 aa, Artificial Sequence
  GFR-binding peptide
  MOD_RES (4)..(4): Xaa is C or S
KPTXAPTKLEPLTVLYY

SEQ ID NO: 1931 - protein, 14 aa, Artificial Sequence
  GFR-binding peptide
  MOD_RES (1)..(1): Xaa is C or S
XVSQDLSPISILFI

SEQ ID NO: 1932 - protein, 19 aa, Artificial Sequence
  GFR-binding peptide
  MOD_RES (6)..(6): Xaa is C or S
VTKPTXAPTKLEPLTVLYY

SEQ ID NO: 1933 - protein, 9 aa, Artificial Sequence
  GFR-binding peptide
LSPISVLFI

SEQ ID NO: 1934 - protein, 15 aa, Artificial Sequence
  GFR-binding peptide
  MOD_RES (2)..(2): Xaa is C or S
TXAPTKLEPLPVVYY

SEQ ID NO: 1935 - protein, 16 aa, Artificial Sequence
  GFR-binding peptide
  MOD_RES (2)..(3): Xaa is C or S
AXXVPTELEPLTMLYY

SEQ ID NO: 1936 - protein, 13 aa, Artificial Sequence
  GFR-binding peptide
VSQDLSAISILYL

SEQ ID NO: 1937 - protein, 11 aa, Artificial Sequence
  GFR-binding peptide
QALSPISILFI

SEQ ID NO: 1938 - protein, 14 aa, Artificial Sequence
  GFR-binding peptide
  MOD_RES (1)..(1): Xaa is C or S
XAPTQLEPLTVLYY

SEQ ID NO: 1939 - protein, 15 aa, Artificial Sequence
  GFR-binding peptide
  MOD_RES (1)..(2): Xaa is C or S
XXVPQDLEPLPIVYY

SEQ ID NO: 1940 - protein, 13 aa, Artificial Sequence
  GFR-binding peptide
VSQDLSPISILFI

SEQ ID NO: 1941 - protein, 17 aa, Artificial Sequence
  GFR-binding peptide
  MOD_RES (3)..(4): Xaa is C or S
SPXXVPQDLNAISILYF

SEQ ID NO: 1942 - protein, 18 aa, Artificial Sequence
  GFR-binding peptide
  MOD_RES (4)..(5): Xaa is C or S
ASPXXVPQDLSPISILFI

SEQ ID NO: 1943 - protein, 18 aa, Artificial Sequence
  GFR-binding peptide
  MOD_RES (4)..(5): Xaa is C or S
ASPXXVPQDLSAISILYL

SEQ ID NO: 1944 - protein, 20 aa, Artificial Sequence
  GFR-binding peptide
  MOD_RES (7)..(7): Xaa is C or S
HVTKPTXAPTKLEPLPVVYY

SEQ ID NO: 1945 - protein, 19 aa, Artificial Sequence
  GFR-binding peptide
  MOD_RES (5)..(6): Xaa is C or S
IPKAXXVPTELEPLTMLYY

SEQ ID NO: 1946 - protein, 15 aa, Artificial Sequence
  GFR-binding peptide
  MOD_RES (1)..(2): Xaa is C or S
XXVPQALSAISILYL

SEQ ID NO: 1947 - protein, 15 aa, Artificial Sequence
  GFR-binding peptide
  MOD_RES (1)..(2): Xaa is C or S
XXVPQALSPISILFI

SEQ ID NO: 1948 - protein, 16 aa, Artificial Sequence
  GFR-binding peptide
  MOD_RES (2)..(3): Xaa is C or S
PXXVPQDLSPISILFI

SEQ ID NO: 1949 - protein, 17 aa, Artificial Sequence
  GFR-binding peptide
  MOD_RES (3)..(4): Xaa is C or S
KAXXVPTELEPLTMLYY

SEQ ID NO: 1950 - protein, 16 aa, Artificial Sequence
  GFR-binding peptide
  MOD_RES (2)..(3): Xaa is C or S
PXXAPTKLSPISVLFI

SEQ ID NO: 1951 - protein, 18 aa, Artificial Sequence
  GFR-binding peptide
  MOD_RES (4)..(5): Xaa is C or S
PKAXXVPTELNAISMLYF

SEQ ID NO: 1952 - protein, 17 aa, Artificial Sequence
  GFR-binding peptide
  MOD_RES (3)..(4): Xaa is C or S
APXXVPQALEPLTILYY

SEQ ID NO: 1953 - protein, 10 aa, Artificial Sequence
  GFR-binding peptide
QLEPLTVLYY

SEQ ID NO: 1954 - protein, 19 aa, Artificial Sequence
  GFR-binding peptide
  MOD_RES (5)..(6): Xaa is C or S
SASPXXVPQDLEPLPIVYY

SEQ ID NO: 1955 - protein, 11 aa, Artificial Sequence
  GFR-binding peptide
QALEPLTILYY

SEQ ID NO: 1956 - protein, 14 aa, Artificial Sequence
  GFR-binding peptide
  MOD_RES (1)..(1): Xaa is C or S
XAPTQLSPISVLFI

SEQ ID NO: 1957 - protein, 19 aa, Artificial Sequence
  GFR-binding peptide
  MOD_RES (5)..(6): Xaa is C or S
VPKPXXAPTQLSPISVLFI

SEQ ID NO: 1958 - protein, 17 aa, Artificial Sequence
  GFR-binding peptide
  MOD_RES (3)..(4): Xaa is C or S
KAXXVPTELNAISMLYF

SEQ ID NO: 1959 - protein, 12 aa, Artificial Sequence
  GFR-binding peptide
PTRLNAISILYF

SEQ ID NO: 1960 - protein, 20 aa, Artificial Sequence
  GFR-binding peptide
  MOD_RES (6)..(7): Xaa is C or S
TVPKPXXAPTQLSPISVLFI

SEQ ID NO: 1961 - protein, 17 aa, Artificial Sequence
  GFR-binding peptide
  MOD_RES (3)..(4): Xaa is C or S
APXXVPQALNAISILYF

SEQ ID NO: 1962 - protein, 9 aa, Artificial Sequence
  GFR-binding peptide
LEPLPMVYY

SEQ ID NO: 1963 - protein, 14 aa, Artificial Sequence
  GFR-binding peptide
  MOD_RES (1)..(1): Xaa is C or S
XVSQDLEPLPIVYY

SEQ ID NO: 1964 - protein, 20 aa, Artificial Sequence
  GFR-binding peptide
  MOD_RES (6)..(7): Xaa is C or S
TVPKPXXAPTQLSAISVLYL

SEQ ID NO: 1965 - protein, 18 aa, Artificial Sequence
  GFR-binding peptide
  MOD_RES (4)..(5): Xaa is C or S
AAPXXVPQALSAISILYL

SEQ ID NO: 1966 - protein, 13 aa, Artificial Sequence
  GFR-binding peptide
VPTELEPLPMVYY

SEQ ID NO: 1967 - protein, 11 aa, Artificial Sequence
  GFR-binding peptide
TQLSPISVLFI

SEQ ID NO: 1968 - protein, 18 aa, Artificial Sequence
  GFR-binding peptide
  MOD_RES (4)..(5): Xaa is C or S
AAPXXVPQALSPISILFI

SEQ ID NO: 1969 - protein, 19 aa, Artificial Sequence
  GFR-binding peptide
  MOD_RES (5)..(6): Xaa is C or S
VPKPXXAPTQLSAISVLYL

SEQ ID NO: 1970 - protein, 15 aa, Artificial Sequence
  GFR-binding peptide
  MOD_RES (1)..(2): Xaa is C or S
XXVPTELEPLPMVYY

SEQ ID NO: 1971 - protein, 9 aa, Artificial Sequence
  GFR-binding peptide
LEPLTVLYY

SEQ ID NO: 1972 - protein, 11 aa, Artificial Sequence
  GFR-binding peptide
TELNAISMLYF

SEQ ID NO: 1973 - protein, 13 aa, Artificial Sequence
  GFR-binding peptide
APTQLSPISVLFI

SEQ ID NO: 1974 - protein, 14 aa, Artificial Sequence
  GFR-binding peptide
  MOD_RES (1)..(1): Xaa is C or S
XVPQALSAISILYL

SEQ ID NO: 1975 - protein, 20 aa, Artificial Sequence
  GFR-binding peptide
  MOD_RES (7)..(7): Xaa is C or S
HVTKPTXAPTKLSAISVLYL

SEQ ID NO: 1976 - protein, 13 aa, Artificial Sequence
  GFR-binding peptide
APTKLSAISVLYL

SEQ ID NO: 1977 - protein, 13 aa, Artificial Sequence
  GFR-binding peptide
VSQDLEPLPIVYY

SEQ ID NO: 1978 - protein, 19 aa, Artificial Sequence
  GFR-binding peptide
  MOD_RES (5)..(6): Xaa is C or S
VPKPXXAPTQLEPLTVLYY

SEQ ID NO: 1979 - protein, 14 aa, Artificial Sequence
  GFR-binding peptide
  MOD_RES (1)..(1): Xaa is C or S
XVPTELEPLTMLYY

SEQ ID NO: 1980 - protein, 10 aa, Artificial Sequence
  GFR-binding peptide
ALSPISILFI

SEQ ID NO: 1981 - protein, 15 aa, Artificial Sequence
  GFR-binding peptide
  MOD_RES (1)..(2): Xaa is C or S
XXVPTRLEPLPIVYY

SEQ ID NO: 1982 - protein, 20 aa, Artificial Sequence
  GFR-binding peptide
  MOD_RES (6)..(7): Xaa is C or S
YVPKPXXAPTKLEPLTVLYY

SEQ ID NO: 1983 - protein, 14 aa, Artificial Sequence
  GFR-binding peptide
  MOD_RES (1)..(1): Xaa is C or S
XVPTELEPLPMVYY

SEQ ID NO: 1984 - protein, 17 aa, Artificial Sequence
  GFR-binding peptide
  MOD_RES (3)..(4): Xaa is C or S
SPXXVPQDLEPLPIVYY

SEQ ID NO: 1985 - protein, 19 aa, Artificial Sequence
  GFR-binding peptide
  MOD_RES (5)..(6): Xaa is C or S
SASPXXVPQDLSAISILYL

SEQ ID NO: 1986 - protein, 13 aa, Artificial Sequence
  GFR-binding peptide
VPQALSPISILFI

SEQ ID NO: 1987 - protein, 17 aa, Artificial Sequence
  GFR-binding peptide
  MOD_RES (4)..(4): Xaa is C or S
KPTXAPTKLSAISVLYL

SEQ ID NO: 1988 - protein, 16 aa, Artificial Sequence
  GFR-binding peptide
  MOD_RES (2)..(3): Xaa is C or S
PXXVSQDLEPLPIVYY

SEQ ID NO: 1989 - protein, 15 aa, Artificial Sequence
  GFR-binding peptide
  MOD_RES (1)..(2): Xaa is C or S
XXVPQDLNAISILYF

SEQ ID NO: 1990 - protein, 20 aa, Artificial Sequence
  GFR-binding peptide
  MOD_RES (6)..(7): Xaa is C or S
SIPKAXXVPTELEPLTMLYY

SEQ ID NO: 1991 - protein, 12 aa, Artificial Sequence
  GFR-binding peptide
SQDLSPISILFI

SEQ ID NO: 1992 - protein, 16 aa, Artificial Sequence
  GFR-binding peptide
  MOD_RES (2)..(3): Xaa is C or S
TXXVPTRLNAISILYF

SEQ ID NO: 1993 - protein, 9 aa, Artificial Sequence
  GFR-binding peptide
LEPLTMLYY

SEQ ID NO: 1994 - protein, 11 aa, Artificial Sequence
  GFR-binding peptide
TKLSAISVLYL

SEQ ID NO: 1995 - protein, 20 aa, Artificial Sequence
  GFR-binding peptide
  MOD_RES (6)..(7): Xaa is C or S
KIPKAXXVPTELNAISMLYF

SEQ ID NO: 1996 - protein, 10 aa, Artificial Sequence
  GFR-binding peptide
KLEPLTVLYY

SEQ ID NO: 1997 - protein, 15 aa, Artificial Sequence
  GFR-binding peptide
  MOD_RES (1)..(2): Xaa is C or S
XXVSQDLEPLPIVYY

SEQ ID NO: 1998 - protein, 12 aa, Artificial Sequence
  GFR-binding peptide
PTELEPLTMLYY

SEQ ID NO: 1999 - protein, 20 aa, Artificial Sequence
  GFR-binding peptide
  MOD_RES (6)..(7): Xaa is C or S
TVPKPXXAPTQLEPLTVLYY

SEQ ID NO: 2000 - protein, 14 aa, Artificial Sequence
  GFR-binding peptide
  MOD_RES (1)..(1): Xaa is C or S
XAPTKLSPISVLFI

SEQ ID NO: 2001 - protein, 10 aa, Artificial Sequence
  GFR-binding peptide
RLNAISILYF

SEQ ID NO: 2002 - protein, 17 aa, Artificial Sequence
  GFR-binding peptide
  MOD_RES (3)..(4): Xaa is C or S
KPXXAPTKLSAISVLYL

SEQ ID NO: 2003 - protein, 12 aa, Artificial Sequence
  GFR-binding peptide
SQDLNAISILYF

SEQ ID NO: 2004 - protein, 12 aa, Artificial Sequence
  GFR-binding peptide
PTKLEPLPVVYY

SEQ ID NO: 2005 - protein, 10 aa, Artificial Sequence
  GFR-binding peptide
ALNAISILYF

SEQ ID NO: 2006 - protein, 15 aa, Artificial Sequence
  GFR-binding peptide
  MOD_RES (1)..(2): Xaa is C or S
XXVPTRLEPLTILYY

SEQ ID NO: 2007 - protein, 16 aa, Artificial Sequence
  GFR-binding peptide
  MOD_RES (2)..(3): Xaa is C or S
PXXAPTQLSPISVLFI

SEQ ID NO: 2008 - protein, 10 aa, Artificial Sequence
  GFR-binding peptide
DLSPISILFI

SEQ ID NO: 2009 - protein, 19 aa, Artificial Sequence
  GFR-binding peptide
  MOD_RES (5)..(6): Xaa is C or S
VPKPXXAPTKLSPISVLFI

SEQ ID NO: 2010 - protein, 15 aa, Artificial Sequence
  GFR-binding peptide
  MOD_RES (1)..(2): Xaa is C or S
XXVPQDLSPISILFI

SEQ ID NO: 2011 - protein, 15 aa, Artificial Sequence
  GFR-binding peptide
  MOD_RES (1)..(2): Xaa is C or S
XXVPQALNAISILYF

SEQ ID NO: 2012 - protein, 13 aa, Artificial Sequence
  GFR-binding peptide
VPQDLSAISILYL

SEQ ID NO: 2013 - protein, 13 aa, Artificial Sequence
  GFR-binding peptide
VPQALNAISILYF

SEQ ID NO: 2014 - protein, 19 aa, Artificial Sequence
  GFR-binding peptide
  MOD_RES (5)..(6): Xaa is C or S
SAAPXXVPQALEPLTILYY

SEQ ID NO: 2015 - protein, 14 aa, Artificial Sequence
  GFR-binding peptide
  MOD_RES (1)..(1): Xaa is C or S
XVPQDLSPISILFI

SEQ ID NO: 2016 - protein, 14 aa, Artificial Sequence
  GFR-binding peptide
  MOD_RES (1)..(1): Xaa is C or S
XVPQDLSAISILYL

SEQ ID NO: 2017 - protein, 10 aa, Artificial Sequence
  GFR-binding peptide
KLEPLPVVYY

SEQ ID NO: 2018 - protein, 19 aa, Artificial Sequence
  GFR-binding peptide
  MOD_RES (5)..(6): Xaa is C or S
TPPTXXVPTRLEPLPIVYY

SEQ ID NO: 2019 - protein, 18 aa, Artificial Sequence
  GFR-binding peptide
  MOD_RES (4)..(5): Xaa is C or S
PKPXXAPTKLSAISVLYL

SEQ ID NO: 2020 - protein, 14 aa, Artificial Sequence
  GFR-binding peptide
  MOD_RES (1)..(1): Xaa is C or S
XVSQDLNAISILYF

SEQ ID NO: 2021 - protein, 17 aa, Artificial Sequence
  GFR-binding peptide
  MOD_RES (3)..(4): Xaa is C or S
PTXXVPTRLEPLTILYY

SEQ ID NO: 2022 - protein, 10 aa, Artificial Sequence
  GFR-binding peptide
QLEPLPVVYY

SEQ ID NO: 2023 - protein, 14 aa, Artificial Sequence
  GFR-binding peptide
  MOD_RES (1)..(1): Xaa is C or S
XVPQDLNAISILYF

SEQ ID NO: 2024 - protein, 13 aa, Artificial Sequence
  GFR-binding peptide
VPQDLNAISILYF

SEQ ID NO: 2025 - protein, 15 aa, Artificial Sequence
  GFR-binding peptide
  MOD_RES (1)..(2): Xaa is C or S
XXAPTKLSPISVLFI

SEQ ID NO: 2026 - protein, 12 aa, Artificial Sequence
  GFR-binding peptide
PTELEPLPMVYY

SEQ ID NO: 2027 - protein, 18 aa, Artificial Sequence
  GFR-binding peptide
  MOD_RES (4)..(5): Xaa is C or S
PPTXXVPTRLEPLPIVYY

SEQ ID NO: 2028 - protein, 15 aa, Artificial Sequence
  GFR-binding peptide
  MOD_RES (1)..(2): Xaa is C or S
XXAPTKLSAISVLYL

SEQ ID NO: 2029 - protein, 18 aa, Artificial Sequence
  GFR-binding peptide
  MOD_RES (4)..(5): Xaa is C or S
PKPXXAPTKLSPISVLFI

SEQ ID NO: 2030 - protein, 9 aa, Artificial Sequence
  GFR-binding peptide
LSAISILYL

SEQ ID NO: 2031 - protein, 10 aa, Artificial Sequence
  GFR-binding peptide
DLNAISILYF

SEQ ID NO: 2032 - protein, 18 aa, Artificial Sequence
  GFR-binding peptide
  MOD_RES (4)..(5): Xaa is C or S
PKPXXAPTQLSAISVLYL

SEQ ID NO: 2033 - protein, 18 aa, Artificial Sequence
  GFR-binding peptide
  MOD_RES (4)..(5): Xaa is C or S
PKPXXAPTQLSPISVLFI

SEQ ID NO: 2034 - protein, 15 aa, Artificial Sequence
  GFR-binding peptide
  MOD_RES (1)..(2): Xaa is C or S
XXAPTQLSAISVLYL

SEQ ID NO: 2035 - protein, 15 aa, Artificial Sequence
  GFR-binding peptide
  MOD_RES (1)..(2): Xaa is C or S
XXAPTQLSPISVLFI

SEQ ID NO: 2036 - protein, 20 aa, Artificial Sequence
  GFR-binding peptide
  MOD_RES (6)..(7): Xaa is C or S
ASAAPXXVPQALNAISILYF

SEQ ID NO: 2037 - protein, 19 aa, Artificial Sequence
  GFR-binding peptide
  MOD_RES (6)..(6): Xaa is C or S
VTKPTXAPTKLSPISVLFI

SEQ ID NO: 2038 - protein, 19 aa, Artificial Sequence
  GFR-binding peptide
  MOD_RES (6)..(6): Xaa is C or S
VTKPTXAPTKLSAISVLYL

SEQ ID NO: 2039 - protein, 20 aa, Artificial Sequence
  GFR-binding peptide
  MOD_RES (6)..(7): Xaa is C or S
ASAAPXXVPQALSAISILYL

SEQ ID NO: 2040 - protein, 18 aa, Artificial Sequence
  GFR-binding peptide
  MOD_RES (4)..(5): Xaa is C or S
ASPXXVSQDLNAISILYF

SEQ ID NO: 2041 - protein, 16 aa, Artificial Sequence
  GFR-binding peptide
  MOD_RES (2)..(3): Xaa is C or S
TXXVPTRLSAISILYL

SEQ ID NO: 2042 - protein, 12 aa, Artificial Sequence
  GFR-binding peptide
PQALSAISILYL

SEQ ID NO: 2043 - protein, 12 aa, Artificial Sequence
  GFR-binding peptide
PQALSPISILFI

SEQ ID NO: 2044 - protein, 18 aa, Artificial Sequence
  GFR-binding peptide
  MOD_RES (5)..(5): Xaa is C or S
TKPTXAPTKLSPISVLFI

SEQ ID NO: 2045 - protein, 19 aa, Artificial Sequence
  GFR-binding peptide
  MOD_RES (5)..(6): Xaa is C or S
IPKAXXVPTELEPLPMVYY

SEQ ID NO: 2046 - protein, 12 aa, Artificial Sequence
  GFR-binding peptide
PTKLEPLTVLYY

SEQ ID NO: 2047 - protein, 12 aa, Artificial Sequence
  GFR-binding peptide
PQALNAISILYF

SEQ ID NO: 2048 - protein, 13 aa, Artificial Sequence
  GFR-binding peptide
VPTRLEPLPIVYY

SEQ ID NO: 2049 - protein, 12 aa, Artificial Sequence
  GFR-binding peptide
PQDLSAISILYL

SEQ ID NO: 2050 - protein, 12 aa, Artificial Sequence
  GFR-binding peptide
PQDLSPISILFI

SEQ ID NO: 2051 - protein, 20 aa, Artificial Sequence
  GFR-binding peptide
  MOD_RES (6)..(7): Xaa is C or S
KIPKAXXVPTELSPISMLFI

SEQ ID NO: 2052 - protein, 15 aa, Artificial Sequence
  GFR-binding peptide
  MOD_RES (2)..(2): Xaa is C or S
TXAPTKLEPLTVLYY

SEQ ID NO: 2053 - protein, 10 aa, Artificial Sequence
  GFR-binding peptide
ELEPLPMVYY

SEQ ID NO: 2054 - protein, 19 aa, Artificial Sequence
  GFR-binding peptide
  MOD_RES (5)..(6): Xaa is C or S
SASPXXVSQDLEPLPIVYY

SEQ ID NO: 2055 - protein, 18 aa, Artificial Sequence
  GFR-binding peptide
  MOD_RES (5)..(5): Xaa is C or S
TKPTXAPTKLSAISVLYL

SEQ ID NO: 2056 - protein, 11 aa, Artificial Sequence
  GFR-binding peptide
TRLEPLTILYY

SEQ ID NO: 2057 - protein, 18 aa, Artificial Sequence
  GFR-binding peptide
  MOD_RES (4)..(5): Xaa is C or S
ASPXXVSQDLSPISILFI

SEQ ID NO: 2058 - protein, 17 aa, Artificial Sequence
  GFR-binding peptide
  MOD_RES (3)..(4): Xaa is C or S
KPXXAPTQLSPISVLFI

SEQ ID NO: 2059 - protein, 20 aa, Artificial Sequence
  GFR-binding peptide
  MOD_RES (6)..(7): Xaa is C or S
YVPKPXXAPTKLEPLPVVYY

SEQ ID NO: 2060 - protein, 18 aa, Artificial Sequence
  GFR-binding peptide
  MOD_RES (4)..(5): Xaa is C or S
ASPXXVSQDLSAISILYL

SEQ ID NO: 2061 - protein, 17 aa, Artificial Sequence
  GFR-binding peptide
  MOD_RES (3)..(4): Xaa is C or S
KPXXAPTQLSAISVLYL

SEQ ID NO: 2062 - protein, 9 aa, Artificial Sequence
  GFR-binding peptide
LNAISILYF

SEQ ID NO: 2063 - protein, 11 aa, Artificial Sequence
  GFR-binding peptide
TELSPISMLFI

SEQ ID NO: 2064 - protein, 14 aa, Artificial Sequence
  GFR-binding peptide
  MOD_RES (1)..(1): Xaa is C or S
XVPQALNAISILYF

SEQ ID NO: 2065 - protein, 12 aa, Artificial Sequence
  GFR-binding peptide
PTQLEPLPVVYY

SEQ ID NO: 2066 - protein, 10 aa, Artificial Sequence
  GFR-binding peptide
QLSAISVLYL

SEQ ID NO: 2067 - protein, 18 aa, Artificial Sequence
  GFR-binding peptide
  MOD_RES (4)..(5): Xaa is C or S
PKPXXAPTKLEPLTVLYY

SEQ ID NO: 2068 - protein, 18 aa, Artificial Sequence
  GFR-binding peptide
  MOD_RES (4)..(5): Xaa is C or S
PKAXXVPTELEPLPMVYY

SEQ ID NO: 2069 - protein, 19 aa, Artificial Sequence
  GFR-binding peptide
  MOD_RES (5)..(6): Xaa is C or S
SAAPXXVPQALNAISILYF

SEQ ID NO: 2070 - protein, 18 aa, Artificial Sequence
  GFR-binding peptide
  MOD_RES (4)..(5): Xaa is C or S
ASPXXVSQDLEPLPIVYY

SEQ ID NO: 2071 - protein, 10 aa, Artificial Sequence
  GFR-binding peptide
KLSPISVLFI

SEQ ID NO: 2072 - protein, 12 aa, Artificial Sequence
  GFR-binding peptide
PTELNAISMLYF

SEQ ID NO: 2073 - protein, 10 aa, Artificial Sequence
  GFR-binding peptide
RLSAISILYL

SEQ ID NO: 2074 - protein, 10 aa, Artificial Sequence
  GFR-binding peptide
ELSPISMLFI

SEQ ID NO: 2075 - protein, 13 aa, Artificial Sequence
  GFR-binding peptide
VPQALEPLTILYY

SEQ ID NO: 2076 - protein, 17 aa, Artificial Sequence
  GFR-binding peptide
  MOD_RES (3)..(4): Xaa is C or S
PTXXVPTRLEPLPIVYY

SEQ ID NO: 2077 - protein, 13 aa, Artificial Sequence
  GFR-binding peptide
APTQLEPLTVLYY

SEQ ID NO: 2078 - protein, 18 aa, Artificial Sequence
  GFR-binding peptide
  MOD_RES (4)..(5): Xaa is C or S
PPTXXVPTRLEPLTILYY

SEQ ID NO: 2079 - protein, 12 aa, Artificial Sequence
  GFR-binding peptide
PQDLNAISILYF

SEQ ID NO: 2080 - protein, 12 aa, Artificial Sequence
  GFR-binding peptide
PTQLEPLTVLYY

SEQ ID NO: 2081 - protein, 18 aa, Artificial Sequence
  GFR-binding peptide
  MOD_RES (4)..(5): Xaa is C or S
PKPXXAPTKLEPLPVVYY

SEQ ID NO: 2082 - protein, 11 aa, Artificial Sequence
  GFR-binding peptide
TRLSAISILYL

SEQ ID NO: 2083 - protein, 14 aa, Artificial Sequence
  GFR-binding peptide
  MOD_RES (1)..(1): Xaa is C or S
XAPTKLSAISVLYL

SEQ ID NO: 2084 - protein, 19 aa, Artificial Sequence
  GFR-binding peptide
  MOD_RES (5)..(6): Xaa is C or S
VPKPXXAPTKLSAISVLYL

SEQ ID NO: 2085 - protein, 19 aa, Artificial Sequence
  GFR-binding peptide
  MOD_RES (5)..(6): Xaa is C or S
IPKAXXVPTELNAISMLYF

SEQ ID NO: 2086 - protein, 17 aa, Artificial Sequence
  GFR-binding peptide
  MOD_RES (3)..(4): Xaa is C or S
SPXXVPQDLSAISILYL

SEQ ID NO: 2087 - protein, 11 aa, Artificial Sequence
  GFR-binding peptide
TKLSPISVLFI

SEQ ID NO: 2088 - protein, 19 aa, Artificial Sequence
  GFR-binding peptide
  MOD_RES (5)..(6): Xaa is C or S
SASPXXVPQDLNAISILYF

SEQ ID NO: 2089 - protein, 20 aa, Artificial Sequence
  GFR-binding peptide
  MOD_RES (6)..(7): Xaa is C or S
SIPKAXXVPTELNAISMLYF

SEQ ID NO: 2090 - protein, 13 aa, Artificial Sequence
  GFR-binding peptide
VPTRLEPLTILYY

SEQ ID NO: 2091 - protein, 11 aa, Artificial Sequence
  GFR-binding peptide
TELEPLPMVYY

SEQ ID NO: 2092 - protein, 16 aa, Artificial Sequence
  GFR-binding peptide
  MOD_RES (2)..(3): Xaa is C or S
AXXVPTELNAISMLYF

SEQ ID NO: 2093 - protein, 17 aa, Artificial Sequence
  GFR-binding peptide
  MOD_RES (3)..(4): Xaa is C or S
KPXXAPTKLSPISVLFI

SEQ ID NO: 2094 - protein, 15 aa, Artificial Sequence
  GFR-binding peptide
  MOD_RES (1)..(2): Xaa is C or S
XXVPQDLSAISILYL

SEQ ID NO: 2095 - protein, 12 aa, Artificial Sequence
  GFR-binding peptide
PTRLEPLPIVYY

SEQ ID NO: 2096 - protein, 10 aa, Artificial Sequence
  GFR-binding peptide
DLSAISILYL

SEQ ID NO: 2097 - protein, 9 aa, Artificial Sequence
  GFR-binding peptide
LNAISMLYF

SEQ ID NO: 2098 - protein, 16 aa, Artificial Sequence
  GFR-binding peptide
  MOD_RES (2)..(3): Xaa is C or S
PXXVPQALEPLTILYY

SEQ ID NO: 2099 - protein, 17 aa, Artificial Sequence
  GFR-binding peptide
  MOD_RES (3)..(4): Xaa is C or S
APXXVPQALSAISILYL

SEQ ID NO: 2100 - protein, 16 aa, Artificial Sequence
  GFR-binding peptide
  MOD_RES (3)..(3): Xaa is C or S
PTXAPTKLSAISVLYL

SEQ ID NO: 2101 - protein, 11 aa, Artificial Sequence
  GFR-binding peptide
QDLEPLPIVYY

SEQ ID NO: 2102 - protein, 14 aa, Artificial Sequence
  GFR-binding peptide
  MOD_RES (1)..(1): Xaa is C or S
XVSQDLSAISILYL

SEQ ID NO: 2103 - protein, 9 aa, Artificial Sequence
  GFR-binding peptide
LSAISVLYL

SEQ ID NO: 2104 - protein, 18 aa, Artificial Sequence
  GFR-binding peptide
  MOD_RES (4)..(5): Xaa is C or S
PKAXXVPTELEPLTMLYY

SEQ ID NO: 2105 - protein, 11 aa, Artificial Sequence
  GFR-binding peptide
QALSAISILYL

SEQ ID NO: 2106 - protein, 17 aa, Artificial Sequence
  GFR-binding peptide
  MOD_RES (3)..(4): Xaa is C or S
KAXXVPTELSPISMLFI

SEQ ID NO: 2107 - protein, 10 aa, Artificial Sequence
  GFR-binding peptide
ELEPLTMLYY

SEQ ID NO: 2108 - protein, 17 aa, Artificial Sequence
  GFR-binding peptide
  MOD_RES (3)..(4): Xaa is C or S
APXXVPQALSPISILFI

SEQ ID NO: 2109 - protein, 16 aa, Artificial Sequence
  GFR-binding peptide
  MOD_RES (2)..(3): Xaa is C or S
PXXVPQDLSAISILYL

SEQ ID NO: 2110 - protein, 20 aa, Artificial Sequence
  GFR-binding peptide
  MOD_RES (6)..(7): Xaa is C or S
ASASPXXVSQDLSAISILYL

SEQ ID NO: 2111 - protein, 18 aa, Artificial Sequence
  GFR-binding peptide
  MOD_RES (4)..(5): Xaa is C or S
AAPXXVPQALNAISILYF

SEQ ID NO: 2112 - protein, 17 aa, Artificial Sequence
  GFR-binding peptide
  MOD_RES (3)..(4): Xaa is C or S
KPXXAPTKLEPLPVVYY

SEQ ID NO: 2113 - protein, 15 aa, Artificial Sequence
  GFR-binding peptide
  MOD_RES (1)..(2): Xaa is C or S
XXVSQDLNAISILYF

SEQ ID NO: 2114 - protein, 12 aa, Artificial Sequence
  GFR-binding peptide
SQDLEPLPIVYY

SEQ ID NO: 2115 - protein, 14 aa, Artificial Sequence
  GFR-binding peptide
  MOD_RES (1)..(1): Xaa is C or S
XVPTRLNAISILYF

SEQ ID NO: 2116 - protein, 14 aa, Artificial Sequence
  GFR-binding peptide
  MOD_RES (1)..(1): Xaa is C or S
XVPTRLSAISILYL

SEQ ID NO: 2117 - protein, 12 aa, Artificial Sequence
  GFR-binding peptide
PTRLEPLTILYY

SEQ ID NO: 2118 - protein, 11 aa, Artificial Sequence
  GFR-binding peptide
TELEPLTMLYY

SEQ ID NO: 2119 - protein, 16 aa, Artificial Sequence
  GFR-binding peptide
  MOD_RES (2)..(3): Xaa is C or S
PXXAPTKLSAISVLYL

SEQ ID NO: 2120 - protein, 19 aa, Artificial Sequence
  GFR-binding peptide
  MOD_RES (5)..(6): Xaa is C or S
TPPTXXVPTRLEPLTILYY

SEQ ID NO: 2121 - protein, 11 aa, Artificial Sequence
  GFR-binding peptide
QALNAISILYF

SEQ ID NO: 2122 - protein, 20 aa, Artificial Sequence
  GFR-binding peptide
  MOD_RES (6)..(7): Xaa is C or S
ASASPXXVSQDLNAISILYF

SEQ ID NO: 2123 - protein, 11 aa, Artificial Sequence
  GFR-binding peptide
TQLSAISVLYL

SEQ ID NO: 2124 - protein, 13 aa, Artificial Sequence
  GFR-binding peptide
VSQDLNAISILYF

SEQ ID NO: 2125 - protein, 14 aa, Artificial Sequence
  GFR-binding peptide
  MOD_RES (1)..(1): Xaa is C or S
XAPTQLSAISVLYL

SEQ ID NO: 2126 - protein, 11 aa, Artificial Sequence
  GFR-binding peptide
QDLSAISILYL

SEQ ID NO: 2127 - protein, 11 aa, Artificial Sequence
  GFR-binding peptide
QDLSPISILFI

SEQ ID NO: 2128 - protein, 18 aa, Artificial Sequence
  GFR-binding peptide
  MOD_RES (4)..(5): Xaa is C or S
PKAXXVPTELSPISMLFI

SEQ ID NO: 2129 - protein, 18 aa, Artificial Sequence
  GFR-binding peptide
  MOD_RES (4)..(5): Xaa is C or S
ASPXXVPQDLNAISILYF

SEQ ID NO: 2130 - protein, 16 aa, Artificial Sequence
  GFR-binding peptide
  MOD_RES (2)..(3): Xaa is C or S
PXXVPQDLNAISILYF

SEQ ID NO: 2131 - protein, 17 aa, Artificial Sequence
  GFR-binding peptide
  MOD_RES (3)..(4): Xaa is C or S
KAXXVPTELEPLPMVYY

SEQ ID NO: 2132 - protein, 18 aa, Artificial Sequence
  GFR-binding peptide
  MOD_RES (4)..(5): Xaa is C or S
PPTXXVPTRLNAISILYF

SEQ ID NO: 2133 - protein, 11 aa, Artificial Sequence
  GFR-binding peptide
TKLEPLTVLYY

SEQ ID NO: 2134 - protein, 15 aa, Artificial Sequence
  GFR-binding peptide
  MOD_RES (1)..(2): Xaa is C or S
XXAPTQLEPLPVVYY

SEQ ID NO: 2135 - protein, 17 aa, Artificial Sequence
  GFR-binding peptide
  MOD_RES (3)..(4): Xaa is C or S
KPXXAPTKLEPLTVLYY

SEQ ID NO: 2136 - protein, 20 aa, Artificial Sequence
  GFR-binding peptide
  MOD_RES (6)..(7): Xaa is C or S
ASAAPXXVPQALEPLTILYY

SEQ ID NO: 2137 - protein, 19 aa, Artificial Sequence
  GFR-binding peptide
  MOD_RES (5)..(6): Xaa is C or S
SASPXXVSQDLSPISILFI

SEQ ID NO: 2138 - protein, 10 aa, Artificial Sequence
  GFR-binding peptide
QLSPISVLFI

SEQ ID NO: 2139 - protein, 14 aa, Artificial Sequence
  GFR-binding peptide
  MOD_RES (1)..(1): Xaa is C or S
XVPQDLEPLPIVYY

SEQ ID NO: 2140 - protein, 19 aa, Artificial Sequence
  GFR-binding peptide
  MOD_RES (5)..(6): Xaa is C or S
SASPXXVSQDLNAISILYF

SEQ ID NO: 2141 - protein, 18 aa, Artificial Sequence
  GFR-binding peptide
  MOD_RES (4)..(5): Xaa is C or S
PKPXXAPTQLEPLTVLYY

SEQ ID NO: 2142 - protein, 15 aa, Artificial Sequence
  GFR-binding peptide
  MOD_RES (1)..(2): Xaa is C or S
XXVPTELSPISMLFI

SEQ ID NO: 2143 - protein, 20 aa, Artificial Sequence
  GFR-binding peptide
  MOD_RES (6)..(7): Xaa is C or S
TVPKPXXAPTQLEPLPVVYY

SEQ ID NO: 2144 - protein, 16 aa, Artificial Sequence
  GFR-binding peptide
  MOD_RES (2)..(3): Xaa is C or S
PXXAPTQLEPLPVVYY

SEQ ID NO: 2145 - protein, 20 aa, Artificial Sequence
  GFR-binding peptide
  MOD_RES (6)..(7): Xaa is C or S
YVPKPXXAPTKLSAISVLYL

SEQ ID NO: 2146 - protein, 16 aa, Artificial Sequence
  GFR-binding peptide
  MOD_RES (2)..(3): Xaa is C or S
PXXVPQALNAISILYF

SEQ ID NO: 2147 - protein, 10 aa, Artificial Sequence
  GFR-binding peptide
KLSAISVLYL

SEQ ID NO: 2148 - protein, 17 aa, Artificial Sequence
  GFR-binding peptide
  MOD_RES (3)..(4): Xaa is C or S
PTXXVPTRLSAISILYL

SEQ ID NO: 2149 - protein, 19 aa, Artificial Sequence
  GFR-binding peptide
  MOD_RES (5)..(6): Xaa is C or S
TPPTXXVPTRLNAISILYF

SEQ ID NO: 2150 - protein, 15 aa, Artificial Sequence
  GFR-binding peptide
  MOD_RES (1)..(2): Xaa is C or S
XXVSQDLSAISILYL

SEQ ID NO: 2151 - protein, 18 aa, Artificial Sequence
  GFR-binding peptide
  MOD_RES (4)..(5): Xaa is C or S
AAPXXVPQALEPLTILYY

SEQ ID NO: 2152 - protein, 11 aa, Artificial Sequence
  GFR-binding peptide
TKLEPLPVVYY

SEQ ID NO: 2153 - protein, 19 aa, Artificial Sequence
  GFR-binding peptide
  MOD_RES (5)..(6): Xaa is C or S
VPKPXXAPTQLEPLPVVYY

SEQ ID NO: 2154 - protein, 20 aa, Artificial Sequence
  GFR-binding peptide
  MOD_RES (6)..(7): Xaa is C or S
STPPTXXVPTRLNAISILYF

SEQ ID NO: 2155 - protein, 15 aa, Artificial Sequence
  GFR-binding peptide
  MOD_RES (1)..(2): Xaa is C or S
XXAPTQLEPLTVLYY

SEQ ID NO: 2156 - protein, 13 aa, Artificial Sequence
  GFR-binding peptide
VPTRLNAISILYF

SEQ ID NO: 2157 - protein, 17 aa, Artificial Sequence
  GFR-binding peptide
  MOD_RES (3)..(4): Xaa is C or S
SPXXVPQDLSPISILFI

SEQ ID NO: 2158 - protein, 19 aa, Artificial Sequence
  GFR-binding peptide
  MOD_RES (5)..(6): Xaa is C or S
SAAPXXVPQALSAISILYL

SEQ ID NO: 2159 - protein, 15 aa, Artificial Sequence
  GFR-binding peptide
  MOD_RES (1)..(2): Xaa is C or S
XXVPTELNAISMLYF

SEQ ID NO: 2160 - protein, 20 aa, Artificial Sequence
  GFR-binding peptide
  MOD_RES (6)..(7): Xaa is C or S
ASASPXXVPQDLSAISILYL

SEQ ID NO: 2161 - protein, 16 aa, Artificial Sequence
  GFR-binding peptide
  MOD_RES (2)..(3): Xaa is C or S
PXXVPQALSPISILFI

SEQ ID NO: 2162 - protein, 18 aa, Artificial Sequence
  GFR-binding peptide
  MOD_RES (4)..(5): Xaa is C or S
ASPXXVPQDLEPLPIVYY

SEQ ID NO: 2163 - protein, 15 aa, Artificial Sequence
  GFR-binding peptide
  MOD_RES (2)..(2): Xaa is C or S
TXAPTKLSAISVLYL

SEQ ID NO: 2164 - protein, 12 aa, Artificial Sequence
  GFR-binding peptide
PTKLSAISVLYL

SEQ ID NO: 2165 - protein, 12 aa, Artificial Sequence
  GFR-binding peptide
PTQLSPISVLFI

SEQ ID NO: 2166 - protein, 15 aa, Artificial Sequence
  GFR-binding peptide
  MOD_RES (1)..(2): Xaa is C or S
XXVPTRLSAISILYL

SEQ ID NO: 2167 - protein, 12 aa, Artificial Sequence
  GFR-binding peptide
PTKLSPISVLFI

SEQ ID NO: 2168 - protein, 13 aa, Artificial Sequence
  GFR-binding peptide
VPTELNAISMLYF

SEQ ID NO: 2169 - protein, 12 aa, Artificial Sequence
  GFR-binding peptide
PQALEPLTILYY

SEQ ID NO: 2170 - protein, 15 aa, Artificial Sequence
  GFR-binding peptide
  MOD_RES (1)..(2): Xaa is C or S
XXVPTRLNAISILYF

SEQ ID NO: 2171 - protein, 18 aa, Artificial Sequence
  GFR-binding peptide
  MOD_RES (5)..(5): Xaa is C or S
TKPTXAPTKLEPLPVVYY

SEQ ID NO: 2172 - protein, 11 aa, Artificial Sequence
  GFR-binding peptide
TRLNAISILYF

SEQ ID NO: 2173 - protein, 15 aa, Artificial Sequence
  GFR-binding peptide
  MOD_RES (1)..(2): Xaa is C or S
XXVPQALEPLTILYY

SEQ ID NO: 2174 - protein, 13 aa, Artificial Sequence
  GFR-binding peptide
APTKLEPLTVLYY

SEQ ID NO: 2175 - protein, 20 aa, Artificial Sequence
  GFR-binding peptide
  MOD_RES (6)..(7): Xaa is C or S
KIPKAXXVPTELEPLPMVYY

SEQ ID NO: 2176 - protein, 10 aa, Artificial Sequence
  GFR-binding peptide
ALEPLTILYY

SEQ ID NO: 2177 - protein, 14 aa, Artificial Sequence
  GFR-binding peptide
  MOD_RES (1)..(1): Xaa is C or S
XVPQALEPLTILYY

SEQ ID NO: 2178 - protein, 16 aa, Artificial Sequence
  GFR-binding peptide
  MOD_RES (2)..(3): Xaa is C or S
PXXVSQDLNAISILYF

SEQ ID NO: 2179 - protein, 17 aa, Artificial Sequence
  GFR-binding peptide
  MOD_RES (3)..(4): Xaa is C or S
SPXXVSQDLSPISILFI

SEQ ID NO: 2180 - protein, 14 aa, Artificial Sequence
  GFR-binding peptide
  MOD_RES (1)..(1): Xaa is C or S
XVPTELNAISMLYF

SEQ ID NO: 2181 - protein, 17 aa, Artificial Sequence
  GFR-binding peptide
  MOD_RES (3)..(4): Xaa is C or S
SPXXVSQDLSAISILYL

SEQ ID NO: 2182 - protein, 20 aa, Artificial Sequence
  GFR-binding peptide
  MOD_RES (6)..(7): Xaa is C or S
ASASPXXVPQDLNAISILYF

SEQ ID NO: 2183 - protein, 12 aa, Artificial Sequence
  GFR-binding peptide
PTQLSAISVLYL

SEQ ID NO: 2184 - protein, 15 aa, Artificial Sequence
  GFR-binding peptide
  MOD_RES (1)..(2): Xaa is C or S
XXAPTKLEPLTVLYY

SEQ ID NO: 2185 - protein, 20 aa, Artificial Sequence
  GFR-binding peptide
  MOD_RES (7)..(7): Xaa is C or S
HVTKPTXAPTKLEPLTVLYY

SEQ ID NO: 2186 - protein, 12 aa, Artificial Sequence
  GFR-binding peptide
PQDLEPLPIVYY

SEQ ID NO: 2187 - protein, 14 aa, Artificial Sequence
  GFR-binding peptide
  MOD_RES (1)..(1): Xaa is C or S
XAPTKLEPLPVVYY

SEQ ID NO: 2188 - protein, 16 aa, Artificial Sequence
  GFR-binding peptide
  MOD_RES (2)..(3): Xaa is C or S
TXXVPTRLEPLPIVYY

SEQ ID NO: 2189 - protein, 18 aa, Artificial Sequence
  GFR-binding peptide
  MOD_RES (4)..(5): Xaa is C or S
PKPXXAPTQLEPLPVVYY

SEQ ID NO: 2190 - protein, 16 aa, Artificial Sequence
  GFR-binding peptide
  MOD_RES (2)..(3): Xaa is C or S
PXXAPTQLEPLTVLYY

SEQ ID NO: 2191 - protein, 17 aa, Artificial Sequence
  GFR-binding peptide
  MOD_RES (3)..(4): Xaa is C or S
PTXXVPTRLNAISILYF

SEQ ID NO: 2192 - protein, 16 aa, Artificial Sequence
  GFR-binding peptide
  MOD_RES (2)..(3): Xaa is C or S
PXXVSQDLSAISILYL

SEQ ID NO: 2193 - protein, 19 aa, Artificial Sequence
  GFR-binding peptide
  MOD_RES (6)..(6): Xaa is C or S
VTKPTXAPTKLEPLPVVYY

SEQ ID NO: 2194 - protein, 13 aa, Artificial Sequence
  GFR-binding peptide
APTQLEPLPVVYY

SEQ ID NO: 2195 - protein, 16 aa, Artificial Sequence
  GFR-binding peptide
  MOD_RES (2)..(3): Xaa is C or S
PXXVSQDLSPISILFI

SEQ ID NO: 2196 - protein, 16 aa, Artificial Sequence
  GFR-binding peptide
  MOD_RES (2)..(3): Xaa is C or S
AXXVPTELEPLPMVYY

SEQ ID NO: 2197 - protein, 12 aa, Artificial Sequence
  GFR-binding peptide
PTELSPISMLFI

SEQ ID NO: 2198 - protein, 18 aa, Artificial Sequence
  GFR-binding peptide
  MOD_RES (4)..(5): Xaa is C or S
PPTXXVPTRLSAISILYL

SEQ ID NO: 2199 - protein, 14 aa, Artificial Sequence
  GFR-binding peptide
  MOD_RES (1)..(1): Xaa is C or S
XVPTELSPISMLFI

SEQ ID NO: 2200 - protein, 17 aa, Artificial Sequence
  GFR-binding peptide
  MOD_RES (3)..(4): Xaa is C or S
SPXXVSQDLNAISILYF

SEQ ID NO: 2201 - protein, 16 aa, Artificial Sequence
  GFR-binding peptide
  MOD_RES (14)..(15): Xaa is C or S
YYLITLPELDQPVXXP

SEQ ID NO: 2202 - protein, 13 aa, Artificial Sequence
  GFR-binding peptide
IFLVSIPSLKTPA

SEQ ID NO: 2203 - protein, 13 aa, Artificial Sequence
  GFR-binding peptide
LYLVSIASLQTPA

SEQ ID NO: 2204 - protein, 14 aa, Artificial Sequence
  GFR-binding peptide
  MOD_RES (14)..(14): Xaa is C or S
IFLISIPSLAQPVX

SEQ ID NO: 2205 - protein, 20 aa, Artificial Sequence
  GFR-binding peptide
  MOD_RES (14)..(14): Xaa is C or S
IFLVSIPSLKTPAXTPKTVH

SEQ ID NO: 2206 - protein, 11 aa, Artificial Sequence
  GFR-binding peptide
YYVIPLPELAQ

SEQ ID NO: 2207 - protein, 11 aa, Artificial Sequence
  GFR-binding peptide
YYLVTLPELQT

SEQ ID NO: 2208 - protein, 13 aa, Artificial Sequence
  GFR-binding peptide
YYVIPLPELDQPV

SEQ ID NO: 2209 - protein, 19 aa, Artificial Sequence
  GFR-binding peptide
  MOD_RES (14)..(15): Xaa is C or S
YYLVTLPELKTPAXXPKPV

SEQ ID NO: 2210 - protein, 19 aa, Artificial Sequence
  GFR-binding peptide
  MOD_RES (14)..(15): Xaa is C or S
LYLISIASLDQSVXXPSAS

SEQ ID NO: 2211 - protein, 10 aa, Artificial Sequence
  GFR-binding peptide
YYLITLPELD

SEQ ID NO: 2212 - protein, 15 aa, Artificial Sequence
  GFR-binding peptide
  MOD_RES (14)..(15): Xaa is C or S
YYLITLPELDQPVXX

SEQ ID NO: 2213 - protein, 17 aa, Artificial Sequence
  GFR-binding peptide
  MOD_RES (14)..(15): Xaa is C or S
YYLVTLPELQTPAXXPK

SEQ ID NO: 2214 - protein, 18 aa, Artificial Sequence
  GFR-binding peptide
  MOD_RES (14)..(14): Xaa is C or S
YYLVTLPELKTPAXTPKT

SEQ ID NO: 2215 - protein, 11 aa, Artificial Sequence
  GFR-binding peptide
FYLISIANLDQ

SEQ ID NO: 2216 - protein, 16 aa, Artificial Sequence
  GFR-binding peptide
  MOD_RES (14)..(15): Xaa is C or S
YYVVPLPELKTPAXXP

SEQ ID NO: 2217 - protein, 13 aa, Artificial Sequence
  GFR-binding peptide
LYLISIASLRTPV

SEQ ID NO: 2218 - protein, 16 aa, Artificial Sequence
  GFR-binding peptide
  MOD_RES (14)..(14): Xaa is C or S
YYLVTLPELKTPAXTP

SEQ ID NO: 2219 - protein, 13 aa, Artificial Sequence
  GFR-binding peptide
LYLISIASLAQPV

SEQ ID NO: 2220 - protein, 10 aa, Artificial Sequence
  GFR-binding peptide
LYLISIASLA

SEQ ID NO: 2221 - protein, 19 aa, Artificial Sequence
  GFR-binding peptide
  MOD_RES (14)..(15): Xaa is C or S
IFLISIPSLDQPVXXPSAS

SEQ ID NO: 2222 - protein, 9 aa, Artificial Sequence
  GFR-binding peptide
YYVVPLPEL

SEQ ID NO: 2223 - protein, 20 aa, Artificial Sequence
  GFR-binding peptide
  MOD_RES (14)..(15): Xaa is C or S
IFLVSIPSLKTPAXXPKPVY

SEQ ID NO: 2224 - protein, 16 aa, Artificial Sequence
  GFR-binding peptide
  MOD_RES (14)..(15): Xaa is C or S
IFLMSIPSLETPVXXA

SEQ ID NO: 2225 - protein, 20 aa, Artificial Sequence
  GFR-binding peptide
  MOD_RES (14)..(15): Xaa is C or S
IFLMSIPSLETPVXXAKPIS

SEQ ID NO: 2226 - protein, 10 aa, Artificial Sequence
  GFR-binding peptide
YYVIPLPELD

SEQ ID NO: 2227 - protein, 13 aa, Artificial Sequence
  GFR-binding peptide
YYLMTLPELETPV

SEQ ID NO: 2228 - protein, 11 aa, Artificial Sequence
  GFR-binding peptide
YYVIPLPELRT

SEQ ID NO: 2229 - protein, 19 aa, Artificial Sequence
  GFR-binding peptide
  MOD_RES (14)..(15): Xaa is C or S
YYVVPLPELKTPAXXPKPV

SEQ ID NO: 2230 - protein, 15 aa, Artificial Sequence
  GFR-binding peptide
  MOD_RES (14)..(15): Xaa is C or S
YYLMTLPELETPVXX

SEQ ID NO: 2231 - protein, 9 aa, Artificial Sequence
  GFR-binding peptide
IFLMSIPSL

SEQ ID NO: 2232 - protein, 14 aa, Artificial Sequence
  GFR-binding peptide
  MOD_RES (14)..(14): Xaa is C or S
YYLITLPELDQSVX

SEQ ID NO: 2233 - protein, 15 aa, Artificial Sequence
  GFR-binding peptide
  MOD_RES (14)..(15): Xaa is C or S
IFLISIPSLDQSVXX

SEQ ID NO: 2234 - protein, 16 aa, Artificial Sequence
  GFR-binding peptide
  MOD_RES (14)..(15): Xaa is C or S
YYVIPLPELDQPVXXP

SEQ ID NO: 2235 - protein, 11 aa, Artificial Sequence
  GFR-binding peptide
YYVVPLPELQT

SEQ ID NO: 2236 - protein, 10 aa, Artificial Sequence
  GFR-binding peptide
FYLMSIANLE

SEQ ID NO: 2237 - protein, 17 aa, Artificial Sequence
  GFR-binding peptide
  MOD_RES (14)..(14): Xaa is C or S
IFLVSIPSLKTPAXTPK

SEQ ID NO: 2238 - protein, 20 aa, Artificial Sequence
  GFR-binding peptide
  MOD_RES (14)..(15): Xaa is C or S
LYLISIASLRTPVXXTPPTS

SEQ ID NO: 2239 - protein, 17 aa, Artificial Sequence
  GFR-binding peptide
  MOD_RES (14)..(15): Xaa is C or S
YYVVPLPELQTPAXXPK

SEQ ID NO: 2240 - protein, 12 aa, Artificial Sequence
  GFR-binding peptide
LYLISIASLDQS

SEQ ID NO: 2241 - protein, 14 aa, Artificial Sequence
  GFR-binding peptide
  MOD_RES (14)..(14): Xaa is C or S
YYVVPLPELQTPAX

SEQ ID NO: 2242 - protein, 17 aa, Artificial Sequence
  GFR-binding peptide
  MOD_RES (14)..(14): Xaa is C or S
YYVVPLPELKTPAXTPK

SEQ ID NO: 2243 - protein, 19 aa, Artificial Sequence
  GFR-binding peptide
  MOD_RES (14)..(15): Xaa is C or S
IFLMSIPSLETPVXXAKPI

SEQ ID NO: 2244 - protein, 10 aa, Artificial Sequence
  GFR-binding peptide
YYLITLPELR

SEQ ID NO: 2245 - protein, 19 aa, Artificial Sequence
  GFR-binding peptide
  MOD_RES (14)..(15): Xaa is C or S
LYLISIASLRTPVXXTPPT

SEQ ID NO: 2246 - protein, 16 aa, Artificial Sequence
  GFR-binding peptide
  MOD_RES (14)..(14): Xaa is C or S
YYVVPLPELKTPAXTP

SEQ ID NO: 2247 - protein, 17 aa, Artificial Sequence
  GFR-binding peptide
  MOD_RES (14)..(15): Xaa is C or S
YYVIPLPELDQSVXXPS

SEQ ID NO: 2248 - protein, 16 aa, Artificial Sequence
  GFR-binding peptide
  MOD_RES (14)..(15): Xaa is C or S
YYLVTLPELKTPAXXP

SEQ ID NO: 2249 - protein, 19 aa, Artificial Sequence
  GFR-binding peptide
  MOD_RES (14)..(15): Xaa is C or S
IFLISIPSLAQPVXXPAAS

SEQ ID NO: 2250 - protein, 14 aa, Artificial Sequence
  GFR-binding peptide
  MOD_RES (14)..(14): Xaa is C or S
YYVIPLPELRTPVX

SEQ ID NO: 2251 - protein, 10 aa, Artificial Sequence
  GFR-binding peptide
FYLVSIANLK

SEQ ID NO: 2252 - protein, 20 aa, Artificial Sequence
  GFR-binding peptide
  MOD_RES (14)..(15): Xaa is C or S
YYLMTLPELETPVXXAKPIK

SEQ ID NO: 2253 - protein, 16 aa, Artificial Sequence
  GFR-binding peptide
  MOD_RES (14)..(15): Xaa is C or S
LYLISIASLAQPVXXP

SEQ ID NO: 2254 - protein, 16 aa, Artificial Sequence
  GFR-binding peptide
  MOD_RES (14)..(15): Xaa is C or S
LYLVSIASLQTPAXXP

SEQ ID NO: 2255 - protein, 18 aa, Artificial Sequence
  GFR-binding peptide
  MOD_RES (14)..(15): Xaa is C or S
FYLVSIANLQTPAXXPKP

SEQ ID NO: 2256 - protein, 15 aa, Artificial Sequence
  GFR-binding peptide
  MOD_RES (14)..(15): Xaa is C or S
YYVVPLPELKTPAXX

SEQ ID NO: 2257 - protein, 13 aa, Artificial Sequence
  GFR-binding peptide
IFLISIPSLDQPV

SEQ ID NO: 2258 - protein, 15 aa, Artificial Sequence
  GFR-binding peptide
  MOD_RES (14)..(14): Xaa is C or S
IFLVSIPSLKTPAXT

SEQ ID NO: 2259 - protein, 13 aa, Artificial Sequence
  GFR-binding peptide
YYVVPLPELKTPA

SEQ ID NO: 2260 - protein, 13 aa, Artificial Sequence
  GFR-binding peptide
IFLMSIPSLETPV

SEQ ID NO: 2261 - protein, 10 aa, Artificial Sequence
  GFR-binding peptide
YYVIPLPELR

SEQ ID NO: 2262 - protein, 20 aa, Artificial Sequence
  GFR-binding peptide
  MOD_RES (14)..(15): Xaa is C or S
YYVMPLPELETPVXXAKPIS

SEQ ID NO: 2263 - protein, 16 aa, Artificial Sequence
  GFR-binding peptide
  MOD_RES (14)..(15): Xaa is C or S
YYLITLPELRTPVXXT

SEQ ID NO: 2264 - protein, 12 aa, Artificial Sequence
  GFR-binding peptide
LYLISIASLRTP

SEQ ID NO: 2265 - protein, 14 aa, Artificial Sequence
  GFR-binding peptide
  MOD_RES (14)..(14): Xaa is C or S
YYLITLPELRTPVX

SEQ ID NO: 2266 - protein, 14 aa, Artificial Sequence
  GFR-binding peptide
  MOD_RES (14)..(14): Xaa is C or S
YYLVTLPELKTPAX

SEQ ID NO: 2267 - protein, 16 aa, Artificial Sequence
  GFR-binding peptide
  MOD_RES (14)..(14): Xaa is C or S
IFLVSIPSLKTPAXTP

SEQ ID NO: 2268 - protein, 17 aa, Artificial Sequence
  GFR-binding peptide
  MOD_RES (14)..(14): Xaa is C or S
YYLVTLPELKTPAXTPK

SEQ ID NO: 2269 - protein, 14 aa, Artificial Sequence
  GFR-binding peptide
  MOD_RES (14)..(14): Xaa is C or S
IFLISIPSLDQSVX

SEQ ID NO: 2270 - protein, 19 aa, Artificial Sequence
  GFR-binding peptide
  MOD_RES (14)..(14): Xaa is C or S
YYLVTLPELKTPAXTPKTV

SEQ ID NO: 2271 - protein, 9 aa, Artificial Sequence
  GFR-binding peptide
IFLVSIPSL

SEQ ID NO: 2272 - protein, 15 aa, Artificial Sequence
  GFR-binding peptide
  MOD_RES (14)..(14): Xaa is C or S
YYVVPLPELKTPAXT

SEQ ID NO: 2273 - protein, 16 aa, Artificial Sequence
  GFR-binding peptide
  MOD_RES (14)..(15): Xaa is C or S
YYLMTLPELETPVXXA

SEQ ID NO: 2274 - protein, 13 aa, Artificial Sequence
  GFR-binding peptide
LYLISIASLDQSV

SEQ ID NO: 2275 - protein, 11 aa, Artificial Sequence
  GFR-binding peptide
IFLISIPSLAQ

SEQ ID NO: 2276 - protein, 11 aa, Artificial Sequence
  GFR-binding peptide
FYLVSIANLKT

SEQ ID NO: 2277 - protein, 14 aa, Artificial Sequence
  GFR-binding peptide
  MOD_RES (14)..(14): Xaa is C or S
YYLVTLPELQTPAX

SEQ ID NO: 2278 - protein, 15 aa, Artificial Sequence
  GFR-binding peptide
  MOD_RES (14)..(15): Xaa is C or S
YYVIPLPELDQPVXX

SEQ ID NO: 2279 - protein, 13 aa, Artificial Sequence
  GFR-binding peptide
IFLISIPSLDQSV

SEQ ID NO: 2280 - protein, 17 aa, Artificial Sequence
  GFR-binding peptide
  MOD_RES (14)..(15): Xaa is C or S
FYLISIANLDQPVXXPS

SEQ ID NO: 2281 - protein, 18 aa, Artificial Sequence
  GFR-binding peptide
  MOD_RES (14)..(15): Xaa is C or S
IFLISIPSLDQPVXXPSA

SEQ ID NO: 2282 - protein, 18 aa, Artificial Sequence
  GFR-binding peptide
  MOD_RES (14)..(15): Xaa is C or S
LYLISIASLDQPVXXPSA

SEQ ID NO: 2283 - protein, 20 aa, Artificial Sequence
  GFR-binding peptide
  MOD_RES (14)..(14): Xaa is C or S
YYVVPLPELKTPAXTPKTVH

SEQ ID NO: 2284 - protein, 19 aa, Artificial Sequence
  GFR-binding peptide
  MOD_RES (14)..(15): Xaa is C or S
YYLMTLPELETPVXXAKPI

SEQ ID NO: 2285 - protein, 15 aa, Artificial Sequence
  GFR-binding peptide
  MOD_RES (14)..(15): Xaa is C or S
LYLISIASLAQPVXX

SEQ ID NO: 2286 - protein, 15 aa, Artificial Sequence
  GFR-binding peptide
  MOD_RES (14)..(15): Xaa is C or S
IFLISIPSLAQPVXX

SEQ ID NO: 2287 - protein, 16 aa, Artificial Sequence
  GFR-binding peptide
  MOD_RES (14)..(15): Xaa is C or S
IFLISIPSLDQPVXXP

SEQ ID NO: 2288 - protein, 17 aa, Artificial Sequence
  GFR-binding peptide
  MOD_RES (14)..(15): Xaa is C or S
YYLMTLPELETPVXXAK

SEQ ID NO: 2289 - protein, 16 aa, Artificial Sequence
  GFR-binding peptide
  MOD_RES (14)..(15): Xaa is C or S
IFLVSIPSLKTPAXXP

SEQ ID NO: 2290 - protein, 14 aa, Artificial Sequence
  GFR-binding peptide
  MOD_RES (14)..(14): Xaa is C or S
IFLISIPSLRTPVX

SEQ ID NO: 2291 - protein, 18 aa, Artificial Sequence
  GFR-binding peptide
  MOD_RES (14)..(15): Xaa is C or S
FYLMSIANLETPVXXAKP

SEQ ID NO: 2292 - protein, 17 aa, Artificial Sequence
  GFR-binding peptide
  MOD_RES (14)..(15): Xaa is C or S
YYLITLPELAQPVXXPA

SEQ ID NO: 2293 - protein, 10 aa, Artificial Sequence
  GFR-binding peptide
YYLVTLPELQ

SEQ ID NO: 2294 - protein, 19 aa, Artificial Sequence
  GFR-binding peptide
  MOD_RES (14)..(15): Xaa is C or S
YYVIPLPELDQPVXXPSAS

SEQ ID NO: 2295 - protein, 11 aa, Artificial Sequence
  GFR-binding peptide
YYLITLPELAQ

SEQ ID NO: 2296 - protein, 19 aa, Artificial Sequence
  GFR-binding peptide
  MOD_RES (14)..(15): Xaa is C or S
YYVIPLPELAQPVXXPAAS

SEQ ID NO: 2297 - protein, 14 aa, Artificial Sequence
  GFR-binding peptide
  MOD_RES (14)..(14): Xaa is C or S
IFLVSIPSLQTPAX

SEQ ID NO: 2298 - protein, 19 aa, Artificial Sequence
  GFR-binding peptide
  MOD_RES (14)..(15): Xaa is C or S
IFLVSIPSLQTPAXXPKPV

SEQ ID NO: 2299 - protein, 17 aa, Artificial Sequence
  GFR-binding peptide
  MOD_RES (14)..(15): Xaa is C or S
FYLMSIANLETPVXXAK

SEQ ID NO: 2300 - protein, 12 aa, Artificial Sequence
  GFR-binding peptide
FYLISIANLRTP

SEQ ID NO: 2301 - protein, 20 aa, Artificial Sequence
  GFR-binding peptide
  MOD_RES (14)..(15): Xaa is C or S
IFLVSIPSLQTPAXXPKPVT

SEQ ID NO: 2302 - protein, 17 aa, Artificial Sequence
  GFR-binding peptide
  MOD_RES (14)..(15): Xaa is C or S
FYLISIANLAQPVXXPA

SEQ ID NO: 2303 - protein, 9 aa, Artificial Sequence
  GFR-binding peptide
YYVMPLPEL

SEQ ID NO: 2304 - protein, 14 aa, Artificial Sequence
  GFR-binding peptide
  MOD_RES (14)..(14): Xaa is C or S
YYVIPLPELDQSVX

SEQ ID NO: 2305 - protein, 20 aa, Artificial Sequence
  GFR-binding peptide
  MOD_RES (14)..(15): Xaa is C or S
LYLVSIASLQTPAXXPKPVT

SEQ ID NO: 2306 - protein, 18 aa, Artificial Sequence
  GFR-binding peptide
  MOD_RES (14)..(15): Xaa is C or S
LYLMSIASLETPVXXAKP

SEQ ID NO: 2307 - protein, 18 aa, Artificial Sequence
  GFR-binding peptide
  MOD_RES (14)..(15): Xaa is C or S
LYLISIASLAQPVXXPAA

SEQ ID NO: 2308 - protein, 13 aa, Artificial Sequence
  GFR-binding peptide
YYVMPLPELETPV

SEQ ID NO: 2309 - protein, 17 aa, Artificial Sequence
  GFR-binding peptide
  MOD_RES (14)..(15): Xaa is C or S
YYLITLPELDQPVXXPS

SEQ ID NO: 2310 - protein, 11 aa, Artificial Sequence
  GFR-binding peptide
IFLVSIPSLQT

SEQ ID NO: 2311 - protein, 18 aa, Artificial Sequence
  GFR-binding peptide
  MOD_RES (14)..(15): Xaa is C or S
IFLISIPSLAQPVXXPAA

SEQ ID NO: 2312 - protein, 19 aa, Artificial Sequence
  GFR-binding peptide
  MOD_RES (14)..(15): Xaa is C or S
LYLVSIASLQTPAXXPKPV

SEQ ID NO: 2313 - protein, 15 aa, Artificial Sequence
  GFR-binding peptide
  MOD_RES (14)..(15): Xaa is C or S
YYVMPLPELETPVXX

SEQ ID NO: 2314 - protein, 9 aa, Artificial Sequence
  GFR-binding peptide
YYLVTLPEL

SEQ ID NO: 2315 - protein, 11 aa, Artificial Sequence
  GFR-binding peptide
FYLMSIANLET

SEQ ID NO: 2316 - protein, 13 aa, Artificial Sequence
  GFR-binding peptide
IFLVSIPSLQTPA

SEQ ID NO: 2317 - protein, 14 aa, Artificial Sequence
  GFR-binding peptide
  MOD_RES (14)..(14): Xaa is C or S
LYLISIASLAQPVX

SEQ ID NO: 2318 - protein, 11 aa, Artificial Sequence
  GFR-binding peptide
LYLMSIASLET

SEQ ID NO: 2319 - protein, 20 aa, Artificial Sequence
  GFR-binding peptide
  MOD_RES (14)..(14): Xaa is C or S
LYLVSIASLKTPAXTPKTVH

SEQ ID NO: 2320 - protein, 18 aa, Artificial Sequence
  GFR-binding peptide
  MOD_RES (14)..(15): Xaa is C or S
YYVIPLPELAQPVXXPAA

SEQ ID NO: 2321 - protein, 13 aa, Artificial Sequence
  GFR-binding peptide
LYLVSIASLKTPA

SEQ ID NO: 2322 - protein, 13 aa, Artificial Sequence
  GFR-binding peptide
YYVIPLPELDQSV

SEQ ID NO: 2323 - protein, 16 aa, Artificial Sequence
  GFR-binding peptide
  MOD_RES (14)..(15): Xaa is C or S
YYLITLPELDQSVXXP

SEQ ID NO: 2324 - protein, 19 aa, Artificial Sequence
  GFR-binding peptide
  MOD_RES (14)..(15): Xaa is C or S
YYLVTLPELQTPAXXPKPV

SEQ ID NO: 2325 - protein, 14 aa, Artificial Sequence
  GFR-binding peptide
  MOD_RES (14)..(14): Xaa is C or S
YYLMTLPELETPVX

SEQ ID NO: 2326 - protein, 8 aa, Artificial Sequence
  GFR-binding peptide
YYVIPLPE

SEQ ID NO: 2327 - protein, 10 aa, Artificial Sequence
  GFR-binding peptide
IFLISIPSLA

SEQ ID NO: 2328 - protein, 14 aa, Artificial Sequence
  GFR-binding peptide
  MOD_RES (14)..(14): Xaa is C or S
FYLVSIANLKTPAX

SEQ ID NO: 2329 - protein, 15 aa, Artificial Sequence
  GFR-binding peptide
  MOD_RES (14)..(15): Xaa is C or S
YYVIPLPELRTPVXX

SEQ ID NO: 2330 - protein, 20 aa, Artificial Sequence
  GFR-binding peptide
  MOD_RES (14)..(15): Xaa is C or S
YYLVTLPELKTPAXXPKPVY

SEQ ID NO: 2331 - protein, 14 aa, Artificial Sequence
  GFR-binding peptide
  MOD_RES (14)..(14): Xaa is C or S
YYVMPLPELETPVX

SEQ ID NO: 2332 - protein, 17 aa, Artificial Sequence
  GFR-binding peptide
  MOD_RES (14)..(15): Xaa is C or S
YYVIPLPELDQPVXXPS

SEQ ID NO: 2333 - protein, 19 aa, Artificial Sequence
  GFR-binding peptide
  MOD_RES (14)..(15): Xaa is C or S
LYLISIASLDQPVXXPSAS

SEQ ID NO: 2334 - protein, 10 aa, Artificial Sequence
  GFR-binding peptide
IFLISIPSLR

SEQ ID NO: 2335 - protein, 13 aa, Artificial Sequence
  GFR-binding peptide
IFLISIPSLAQPV

SEQ ID NO: 2336 - protein, 16 aa, Artificial Sequence
  GFR-binding peptide
  MOD_RES (14)..(15): Xaa is C or S
LYLMSIASLETPVXXA

SEQ ID NO: 2337 - protein, 19 aa, Artificial Sequence
  GFR-binding peptide
  MOD_RES (14)..(14): Xaa is C or S
FYLVSIANLKTPAXTPKTV

SEQ ID NO: 2338 - protein, 17 aa, Artificial Sequence
  GFR-binding peptide
  MOD_RES (14)..(14): Xaa is C or S
LYLVSIASLKTPAXTPK

SEQ ID NO: 2339 - protein, 16 aa, Artificial Sequence
  GFR-binding peptide
  MOD_RES (14)..(15): Xaa is C or S
YYVIPLPELDQSVXXP

SEQ ID NO: 2340 - protein, 15 aa, Artificial Sequence
  GFR-binding peptide
  MOD_RES (14)..(15): Xaa is C or S
FYLISIANLDQPVXX

SEQ ID NO: 2341 - protein, 20 aa, Artificial Sequence
  GFR-binding peptide
  MOD_RES (14)..(15): Xaa is C or S
YYLMTLPELETPVXXAKPIS

SEQ ID NO: 2342 - protein, 12 aa, Artificial Sequence
  GFR-binding peptide
IFLISIPSLDQS

SEQ ID NO: 2343 - protein, 8 aa, Artificial Sequence
  GFR-binding peptide
LYLMSIAS

SEQ ID NO: 2344 - protein, 16 aa, Artificial Sequence
  GFR-binding peptide
  MOD_RES (14)..(15): Xaa is C or S
FYLISIANLRTPVXXT

SEQ ID NO: 2345 - protein, 9 aa, Artificial Sequence
  GFR-binding peptide
YYLMTLPEL

SEQ ID NO: 2346 - protein, 11 aa, Artificial Sequence
  GFR-binding peptide
LYLVSIASLKT

SEQ ID NO: 2347 - protein, 20 aa, Artificial Sequence
  GFR-binding peptide
  MOD_RES (14)..(15): Xaa is C or S
FYLMSIANLETPVXXAKPIK

SEQ ID NO: 2348 - protein, 10 aa, Artificial Sequence
  GFR-binding peptide
YYLVTLPELK

SEQ ID NO: 2349 - protein, 15 aa, Artificial Sequence
  GFR-binding peptide
  MOD_RES (14)..(15): Xaa is C or S
YYVIPLPELDQSVXX

SEQ ID NO: 2350 - protein, 12 aa, Artificial Sequence
  GFR-binding peptide
YYLMTLPELETP

SEQ ID NO: 2351 - protein, 20 aa, Artificial Sequence
  GFR-binding peptide
  MOD_RES (14)..(15): Xaa is C or S
YYLVTLPELQTPAXXPKPVT

SEQ ID NO: 2352 - protein, 15 aa, Artificial Sequence
  GFR-binding peptide
  MOD_RES (14)..(15): Xaa is C or S
FYLVSIANLQTPAXX

SEQ ID NO: 2353 - protein, 14 aa, Artificial Sequence
  GFR-binding peptide
  MOD_RES (14)..(14): Xaa is C or S
IFLVSIPSLKTPAX

SEQ ID NO: 2354 - protein, 10 aa, Artificial Sequence
  GFR-binding peptide
FYLISIANLR

SEQ ID NO: 2355 - protein, 17 aa, Artificial Sequence
  GFR-binding peptide
  MOD_RES (14)..(15): Xaa is C or S
LYLVSIASLKTPAXXPK

SEQ ID NO: 2356 - protein, 12 aa, Artificial Sequence
  GFR-binding peptide
FYLISIANLDQS

SEQ ID NO: 2357 - protein, 12 aa, Artificial Sequence
  GFR-binding peptide
YYVVPLPELKTP

SEQ ID NO: 2358 - protein, 10 aa, Artificial Sequence
  GFR-binding peptide
FYLISIANLA

SEQ ID NO: 2359 - protein, 15 aa, Artificial Sequence
  GFR-binding peptide
  MOD_RES (14)..(15): Xaa is C or S
YYLITLPELRTPVXX

SEQ ID NO: 2360 - protein, 16 aa, Artificial Sequence
  GFR-binding peptide
  MOD_RES (14)..(15): Xaa is C or S
IFLVSIPSLQTPAXXP

SEQ ID NO: 2361 - protein, 10 aa, Artificial Sequence
  GFR-binding peptide
IFLISIPSLD

SEQ ID NO: 2362 - protein, 19 aa, Artificial Sequence
  GFR-binding peptide
  MOD_RES (14)..(15): Xaa is C or S
IFLVSIPSLKTPAXXPKPV

SEQ ID NO: 2363 - protein, 15 aa, Artificial Sequence
  GFR-binding peptide
  MOD_RES (14)..(15): Xaa is C or S
IFLISIPSLDQPVXX

SEQ ID NO: 2364 - protein, 15 aa, Artificial Sequence
  GFR-binding peptide
  MOD_RES (14)..(15): Xaa is C or S
FYLISIANLAQPVXX

SEQ ID NO: 2365 - protein, 13 aa, Artificial Sequence
  GFR-binding peptide
FYLVSIANLQTPA

SEQ ID NO: 2366 - protein, 13 aa, Artificial Sequence
  GFR-binding peptide
LYLISIASLDQPV

SEQ ID NO: 2367 - protein, 13 aa, Artificial Sequence
  GFR-binding peptide
FYLISIANLAQPV

SEQ ID NO: 2368 - protein, 19 aa, Artificial Sequence
  GFR-binding peptide
  MOD_RES (14)..(15): Xaa is C or S
YYLITLPELAQPVXXPAAS

SEQ ID NO: 2369 - protein, 14 aa, Artificial Sequence
  GFR-binding peptide
  MOD_RES (14)..(14): Xaa is C or S
IFLISIPSLDQPVX

SEQ ID NO: 2370 - protein, 14 aa, Artificial Sequence
  GFR-binding peptide
  MOD_RES (14)..(14): Xaa is C or S
LYLISIASLDQPVX

SEQ ID NO: 2371 - protein, 10 aa, Artificial Sequence
  GFR-binding peptide
YYVVPLPELK

SEQ ID NO: 2372 - protein, 19 aa, Artificial Sequence
  GFR-binding peptide
  MOD_RES (14)..(15): Xaa is C or S
YYVIPLPELRTPVXXTPPT

SEQ ID NO: 2373 - protein, 18 aa, Artificial Sequence
  GFR-binding peptide
  MOD_RES (14)..(15): Xaa is C or S
LYLVSIASLKTPAXXPKP

SEQ ID NO: 2374 - protein, 14 aa, Artificial Sequence
  GFR-binding peptide
  MOD_RES (14)..(14): Xaa is C or S
FYLISIANLDQSVX

SEQ ID NO: 2375 - protein, 17 aa, Artificial Sequence
  GFR-binding peptide
  MOD_RES (14)..(15): Xaa is C or S
YYLITLPELRTPVXXTP

SEQ ID NO: 2376 - protein, 10 aa, Artificial Sequence
  GFR-binding peptide
YYVVPLPELQ

SEQ ID NO: 2377 - protein, 14 aa, Artificial Sequence
  GFR-binding peptide
  MOD_RES (14)..(14): Xaa is C or S
FYLISIANLDQPVX

SEQ ID NO: 2378 - protein, 13 aa, Artificial Sequence
  GFR-binding peptide
FYLISIANLDQPV

SEQ ID NO: 2379 - protein, 15 aa, Artificial Sequence
  GFR-binding peptide
  MOD_RES (14)..(15): Xaa is C or S
IFLVSIPSLKTPAXX

SEQ ID NO: 2380 - protein, 17 aa, Artificial Sequence
  GFR-binding peptide
  MOD_RES (14)..(15): Xaa is C or S
YYLITLPELDQSVXXPS

SEQ ID NO: 2381 - protein, 17 aa, Artificial Sequence
  GFR-binding peptide
  MOD_RES (14)..(15): Xaa is C or S
FYLVSIANLQTPAXXPK

SEQ ID NO: 2382 - protein, 12 aa, Artificial Sequence
  GFR-binding peptide
YYVMPLPELETP

SEQ ID NO: 2383 - protein, 18 aa, Artificial Sequence
  GFR-binding peptide
  MOD_RES (14)..(15): Xaa is C or S
YYVIPLPELRTPVXXTPP

SEQ ID NO: 2384 - protein, 15 aa, Artificial Sequence
  GFR-binding peptide
  MOD_RES (14)..(15): Xaa is C or S
LYLVSIASLKTPAXX

SEQ ID NO: 2385 - protein, 9 aa, Artificial Sequence
  GFR-binding peptide
IFLISIPSL

SEQ ID NO: 2386 - protein, 18 aa, Artificial Sequence
  GFR-binding peptide
  MOD_RES (14)..(15): Xaa is C or S
IFLVSIPSLKTPAXXPKP

SEQ ID NO: 2387 - protein, 9 aa, Artificial Sequence
  GFR-binding peptide
LYLISIASL

SEQ ID NO: 2388 - protein, 17 aa, Artificial Sequence
  GFR-binding peptide
  MOD_RES (14)..(15): Xaa is C or S
FYLVSIANLKTPAXXPK

SEQ ID NO: 2389 - protein, 10 aa, Artificial Sequence
  GFR-binding peptide
FYLISIANLD

SEQ ID NO: 2390 - protein, 8 aa, Artificial Sequence
  GFR-binding peptide
FYLVSIAN

SEQ ID NO: 2391 - protein, 18 aa, Artificial Sequence
  GFR-binding peptide
  MOD_RES (14)..(15): Xaa is C or S
LYLVSIASLQTPAXXPKP

SEQ ID NO: 2392 - protein, 18 aa, Artificial Sequence
  GFR-binding peptide
  MOD_RES (14)..(15): Xaa is C or S
IFLVSIPSLQTPAXXPKP

SEQ ID NO: 2393 - protein, 16 aa, Artificial Sequence
  GFR-binding peptide
  MOD_RES (14)..(15): Xaa is C or S
FYLVSIANLQTPAXXP

SEQ ID NO: 2394 - protein, 15 aa, Artificial Sequence
  GFR-binding peptide
  MOD_RES (14)..(15): Xaa is C or S
LYLVSIASLQTPAXX

SEQ ID NO: 2395 - protein, 15 aa, Artificial Sequence
  GFR-binding peptide
  MOD_RES (14)..(15): Xaa is C or S
IFLVSIPSLQTPAXX

SEQ ID NO: 2396 - protein, 20 aa, Artificial Sequence
  GFR-binding peptide
  MOD_RES (14)..(15): Xaa is C or S
LYLMSIASLETPVXXAKPIK

SEQ ID NO: 2397 - protein, 20 aa, Artificial Sequence
  GFR-binding peptide
  MOD_RES (14)..(15): Xaa is C or S
FYLISIANLAQPVXXPAASA

SEQ ID NO: 2398 - protein, 19 aa, Artificial Sequence
  GFR-binding peptide
  MOD_RES (14)..(14): Xaa is C or S
IFLVSIPSLKTPAXTPKTV

SEQ ID NO: 2399 - protein, 19 aa, Artificial Sequence
  GFR-binding peptide
  MOD_RES (14)..(14): Xaa is C or S
LYLVSIASLKTPAXTPKTV

SEQ ID NO: 2400 - protein, 16 aa, Artificial Sequence
  GFR-binding peptide
  MOD_RES (14)..(15): Xaa is C or S
YYVIPLPELAQPVXXP

SEQ ID NO: 2401 - protein, 20 aa, Artificial Sequence
  GFR-binding peptide
  MOD_RES (14)..(15): Xaa is C or S
LYLISIASLAQPVXXPAASA

SEQ ID NO: 2402 - protein, 18 aa, Artificial Sequence
  GFR-binding peptide
  MOD_RES (14)..(15): Xaa is C or S
FYLISIANLDQSVXXPSA

SEQ ID NO: 2403 - protein, 16 aa, Artificial Sequence
  GFR-binding peptide
  MOD_RES (14)..(15): Xaa is C or S
LYLISIASLRTPVXXT

SEQ ID NO: 2404 - protein, 12 aa, Artificial Sequence
  GFR-binding peptide
LYLISIASLAQP

SEQ ID NO: 2405 - protein, 12 aa, Artificial Sequence
  GFR-binding peptide
IFLISIPSLAQP

SEQ ID NO: 2406 - protein, 16 aa, Artificial Sequence
  GFR-binding peptide
  MOD_RES (14)..(15): Xaa is C or S
IFLISIPSLRTPVXXT

SEQ ID NO: 2407 - protein, 18 aa, Artificial Sequence
  GFR-binding peptide
  MOD_RES (14)..(14): Xaa is C or S
IFLVSIPSLKTPAXTPKT

SEQ ID NO: 2408 - protein, 19 aa, Artificial Sequence
  GFR-binding peptide
  MOD_RES (14)..(15): Xaa is C or S
YYVMPLPELETPVXXAKPI

SEQ ID NO: 2409 - protein, 18 aa, Artificial Sequence
  GFR-binding peptide
  MOD_RES (14)..(14): Xaa is C or S
FYLVSIANLKTPAXTPKT

SEQ ID NO: 2410 - protein, 12 aa, Artificial Sequence
  GFR-binding peptide
YYLVTLPELKTP

SEQ ID NO: 2411 - protein, 12 aa, Artificial Sequence
  GFR-binding peptide
FYLISIANLAQP

SEQ ID NO: 2412 - protein, 13 aa, Artificial Sequence
  GFR-binding peptide
YYVIPLPELRTPV

SEQ ID NO: 2413 - protein, 12 aa, Artificial Sequence
  GFR-binding peptide
LYLISIASLDQP

SEQ ID NO: 2414 - protein, 12 aa, Artificial Sequence
  GFR-binding peptide
IFLISIPSLDQP

SEQ ID NO: 2415 - protein, 20 aa, Artificial Sequence
  GFR-binding peptide
  MOD_RES (14)..(15): Xaa is C or S
IFLMSIPSLETPVXXAKPIK

SEQ ID NO: 2416 - protein, 15 aa, Artificial Sequence
  GFR-binding peptide
  MOD_RES (14)..(15): Xaa is C or S
FYLVSIANLKTPAXX

SEQ ID NO: 2417 - protein, 15 aa, Artificial Sequence
  GFR-binding peptide
  MOD_RES (14)..(14): Xaa is C or S
YYLVTLPELKTPAXT

SEQ ID NO: 2418 - protein, 10 aa, Artificial Sequence
  GFR-binding peptide
YYVMPLPELE

SEQ ID NO: 2419 - protein, 19 aa, Artificial Sequence
  GFR-binding peptide
  MOD_RES (14)..(15): Xaa is C or S
YYVIPLPELDQSVXXPSAS

SEQ ID NO: 2420 - protein, 18 aa, Artificial Sequence
  GFR-binding peptide
  MOD_RES (14)..(14): Xaa is C or S
LYLVSIASLKTPAXTPKT

SEQ ID NO: 2421 - protein, 11 aa, Artificial Sequence
  GFR-binding peptide
YYLITLPELRT

SEQ ID NO: 2422 - protein, 18 aa, Artificial Sequence
  GFR-binding peptide
  MOD_RES (14)..(15): Xaa is C or S
FYLVSIANLKTPAXXPKP

SEQ ID NO: 2423 - protein, 18 aa, Artificial Sequence
  GFR-binding peptide
  MOD_RES (14)..(15): Xaa is C or S
IFLISIPSLDQSVXXPSA

SEQ ID NO: 2424 - protein, 17 aa, Artificial Sequence
  GFR-binding peptide
  MOD_RES (14)..(15): Xaa is C or S
IFLVSIPSLQTPAXXPK

SEQ ID NO: 2425 - protein, 20 aa, Artificial Sequence
  GFR-binding peptide
  MOD_RES (14)..(15): Xaa is C or S
YYVVPLPELKTPAXXPKPVY

SEQ ID NO: 2426 - protein, 18 aa, Artificial Sequence
  GFR-binding peptide
  MOD_RES (14)..(15): Xaa is C or S
LYLISIASLDQSVXXPSA

SEQ ID NO: 2427 - protein, 17 aa, Artificial Sequence
  GFR-binding peptide
  MOD_RES (14)..(15): Xaa is C or S
LYLVSIASLQTPAXXPK

SEQ ID NO: 2428 - protein, 9 aa, Artificial Sequence
  GFR-binding peptide
FYLISIANL

SEQ ID NO: 2429 - protein, 13 aa, Artificial Sequence
  GFR-binding peptide
FYLVSIANLKTPA

SEQ ID NO: 2430 - protein, 12 aa, Artificial Sequence
  GFR-binding peptide
YYLITLPELDQS

SEQ ID NO: 2431 - protein, 11 aa, Artificial Sequence
  GFR-binding peptide
IFLMSIPSLET

SEQ ID NO: 2432 - protein, 14 aa, Artificial Sequence
  GFR-binding peptide
  MOD_RES (14)..(14): Xaa is C or S
FYLISIANLAQPVX

SEQ ID NO: 2433 - protein, 12 aa, Artificial Sequence
  GFR-binding peptide
YYVVPLPELQTP

SEQ ID NO: 2434 - protein, 10 aa, Artificial Sequence
  GFR-binding peptide
LYLVSIASLQ

SEQ ID NO: 2435 - protein, 14 aa, Artificial Sequence
  GFR-binding peptide
  MOD_RES (14)..(14): Xaa is C or S
FYLVSIANLQTPAX

SEQ ID NO: 2436 - protein, 18 aa, Artificial Sequence
  GFR-binding peptide
  MOD_RES (14)..(15): Xaa is C or S
YYLVTLPELKTPAXXPKP

SEQ ID NO: 2437 - protein, 15 aa, Artificial Sequence
  GFR-binding peptide
  MOD_RES (14)..(15): Xaa is C or S
LYLMSIASLETPVXX

SEQ ID NO: 2438 - protein, 18 aa, Artificial Sequence
  GFR-binding peptide
  MOD_RES (14)..(15): Xaa is C or S
YYVMPLPELETPVXXAKP

SEQ ID NO: 2439 - protein, 19 aa, Artificial Sequence
  GFR-binding peptide
  MOD_RES (14)..(15): Xaa is C or S
FYLISIANLAQPVXXPAAS

SEQ ID NO: 2440 - protein, 18 aa, Artificial Sequence
  GFR-binding peptide
  MOD_RES (14)..(15): Xaa is C or S
YYVIPLPELDQSVXXPSA

SEQ ID NO: 2441 - protein, 10 aa, Artificial Sequence
  GFR-binding peptide
IFLVSIPSLK

SEQ ID NO: 2442 - protein, 12 aa, Artificial Sequence
  GFR-binding peptide
FYLMSIANLETP

SEQ ID NO: 2443 - protein, 15 aa, Artificial Sequence
  GFR-binding peptide
  MOD_RES (14)..(14): Xaa is C or S
FYLVSIANLKTPAXT

SEQ ID NO: 2444 - protein, 20 aa, Artificial Sequence
  GFR-binding peptide
  MOD_RES (14)..(14): Xaa is C or S
FYLVSIANLKTPAXTPKTVH

SEQ ID NO: 2445 - protein, 17 aa, Artificial Sequence
  GFR-binding peptide
  MOD_RES (14)..(15): Xaa is C or S
IFLISIPSLRTPVXXTP

SEQ ID NO: 2446 - protein, 10 aa, Artificial Sequence
  GFR-binding peptide
LYLISIASLR

SEQ ID NO: 2447 - protein, 10 aa, Artificial Sequence
  GFR-binding peptide
IFLMSIPSLE

SEQ ID NO: 2448 - protein, 13 aa, Artificial Sequence
  GFR-binding peptide
YYLITLPELAQPV

SEQ ID NO: 2449 - protein, 17 aa, Artificial Sequence
  GFR-binding peptide
  MOD_RES (14)..(15): Xaa is C or S
YYVIPLPELRTPVXXTP

SEQ ID NO: 2450 - protein, 16 aa, Artificial Sequence
  GFR-binding peptide
  MOD_RES (14)..(15): Xaa is C or S
FYLVSIANLKTPAXXP

SEQ ID NO: 2451 - protein, 13 aa, Artificial Sequence
  GFR-binding peptide
YYLVTLPELQTPA

SEQ ID NO: 2452 - protein, 18 aa, Artificial Sequence
  GFR-binding peptide
  MOD_RES (14)..(15): Xaa is C or S
YYLITLPELRTPVXXTPP

SEQ ID NO: 2453 - protein, 12 aa, Artificial Sequence
  GFR-binding peptide
YYVIPLPELAQP

SEQ ID NO: 2454 - protein, 12 aa, Artificial Sequence
  GFR-binding peptide
FYLISIANLDQP

SEQ ID NO: 2455 - protein, 12 aa, Artificial Sequence
  GFR-binding peptide
YYLVTLPELQTP

SEQ ID NO: 2456 - protein, 18 aa, Artificial Sequence
  GFR-binding peptide
  MOD_RES (14)..(15): Xaa is C or S
YYVVPLPELKTPAXXPKP

SEQ ID NO: 2457 - protein, 11 aa, Artificial Sequence
  GFR-binding peptide
LYLISIASLRT

SEQ ID NO: 2458 - protein, 14 aa, Artificial Sequence
  GFR-binding peptide
  MOD_RES (14)..(14): Xaa is C or S
LYLVSIASLKTPAX

SEQ ID NO: 2459 - protein, 19 aa, Artificial Sequence
  GFR-binding peptide
  MOD_RES (14)..(15): Xaa is C or S
LYLVSIASLKTPAXXPKPV

SEQ ID NO: 2460 - protein, 19 aa, Artificial Sequence
  GFR-binding peptide
  MOD_RES (14)..(15): Xaa is C or S
FYLMSIANLETPVXXAKPI

SEQ ID NO: 2461 - protein, 17 aa, Artificial Sequence
  GFR-binding peptide
  MOD_RES (14)..(15): Xaa is C or S
LYLISIASLDQPVXXPS

SEQ ID NO: 2462 - protein, 11 aa, Artificial Sequence
  GFR-binding peptide
IFLVSIPSLKT

SEQ ID NO: 2463 - protein, 19 aa, Artificial Sequence
  GFR-binding peptide
  MOD_RES (14)..(15): Xaa is C or S
FYLISIANLDQPVXXPSAS

SEQ ID NO: 2464 - protein, 20 aa, Artificial Sequence
  GFR-binding peptide
  MOD_RES (14)..(15): Xaa is C or S
FYLMSIANLETPVXXAKPIS

SEQ ID NO: 2465 - protein, 13 aa, Artificial Sequence
  GFR-binding peptide
YYLITLPELRTPV

SEQ ID NO: 2466 - protein, 11 aa, Artificial Sequence
  GFR-binding peptide
YYVMPLPELET

SEQ ID NO: 2467 - protein, 16 aa, Artificial Sequence
  GFR-binding peptide
  MOD_RES (14)..(15): Xaa is C or S
FYLMSIANLETPVXXA

SEQ ID NO: 2468 - protein, 17 aa, Artificial Sequence
  GFR-binding peptide
  MOD_RES (14)..(15): Xaa is C or S
IFLVSIPSLKTPAXXPK

SEQ ID NO: 2469 - protein, 15 aa, Artificial Sequence
  GFR-binding peptide
  MOD_RES (14)..(15): Xaa is C or S
LYLISIASLDQPVXX

SEQ ID NO: 2470 - protein, 12 aa, Artificial Sequence
  GFR-binding peptide
YYVIPLPELRTP

SEQ ID NO: 2471 - protein, 10 aa, Artificial Sequence
  GFR-binding peptide
LYLISIASLD

SEQ ID NO: 2472 - protein, 9 aa, Artificial Sequence
  GFR-binding peptide
FYLMSIANL

SEQ ID NO: 2473 - protein, 16 aa, Artificial Sequence
  GFR-binding peptide
  MOD_RES (14)..(15): Xaa is C or S
YYLITLPELAQPVXXP

SEQ ID NO: 2474 - protein, 9 aa, Artificial Sequence
  GFR-binding peptide
FYLVSIANL

SEQ ID NO: 2475 - protein, 13 aa, Artificial Sequence
  GFR-binding peptide
LYLMSIASLETPV

SEQ ID NO: 2476 - protein, 13 aa, Artificial Sequence
  GFR-binding peptide
YYVIPLPELAQPV

SEQ ID NO: 2477 - protein, 17 aa, Artificial Sequence
  GFR-binding peptide
  MOD_RES (14)..(15): Xaa is C or S
LYLISIASLAQPVXXPA

SEQ ID NO: 2478 - protein, 16 aa, Artificial Sequence
  GFR-binding peptide
  MOD_RES (14)..(14): Xaa is C or S
LYLVSIASLKTPAXTP

SEQ ID NO: 2479 - protein, 11 aa, Artificial Sequence
  GFR-binding peptide
YYVIPLPELDQ

SEQ ID NO: 2480 - protein, 14 aa, Artificial Sequence
  GFR-binding peptide
  MOD_RES (14)..(14): Xaa is C or S
LYLISIASLDQSVX

SEQ ID NO: 2481 - protein, 9 aa, Artificial Sequence
  GFR-binding peptide
LYLVSIASL

SEQ ID NO: 2482 - protein, 16 aa, Artificial Sequence
  GFR-binding peptide
  MOD_RES (14)..(14): Xaa is C or S
FYLVSIANLKTPAXTP

SEQ ID NO: 2483 - protein, 19 aa, Artificial Sequence
  GFR-binding peptide
  MOD_RES (14)..(15): Xaa is C or S
YYLITLPELDQSVXXPSAS

SEQ ID NO: 2484 - protein, 18 aa, Artificial Sequence
  GFR-binding peptide
  MOD_RES (14)..(15): Xaa is C or S
YYLMTLPELETPVXXAKP

SEQ ID NO: 2485 - protein, 11 aa, Artificial Sequence
  GFR-binding peptide
LYLISIASLAQ

SEQ ID NO: 2486 - protein, 19 aa, Artificial Sequence
  GFR-binding peptide
  MOD_RES (14)..(15): Xaa is C or S
FYLVSIANLQTPAXXPKPV

SEQ ID NO: 2487 - protein, 18 aa, Artificial Sequence
  GFR-binding peptide
  MOD_RES (14)..(15): Xaa is C or S
YYLITLPELDQPVXXPSA

SEQ ID NO: 2488 - protein, 17 aa, Artificial Sequence
  GFR-binding peptide
  MOD_RES (14)..(15): Xaa is C or S
IFLMSIPSLETPVXXAK

SEQ ID NO: 2489 - protein, 10 aa, Artificial Sequence
  GFR-binding peptide
YYLMTLPELE

SEQ ID NO: 2490 - protein, 17 aa, Artificial Sequence
  GFR-binding peptide
  MOD_RES (14)..(15): Xaa is C or S
IFLISIPSLAQPVXXPA

SEQ ID NO: 2491 - protein, 17 aa, Artificial Sequence
  GFR-binding peptide
  MOD_RES (14)..(15): Xaa is C or S
LYLMSIASLETPVXXAK

SEQ ID NO: 2492 - protein, 16 aa, Artificial Sequence
  GFR-binding peptide
  MOD_RES (14)..(15): Xaa is C or S
LYLISIASLDQPVXXP

SEQ ID NO: 2493 - protein, 12 aa, Artificial Sequence
  GFR-binding peptide
IFLISIPSLRTP

SEQ ID NO: 2494 - protein, 11 aa, Artificial Sequence
  GFR-binding peptide
FYLVSIANLQT

SEQ ID NO: 2495 - protein, 20 aa, Artificial Sequence
  GFR-binding peptide
  MOD_RES (14)..(15): Xaa is C or S
LYLISIASLDQSVXXPSASA

SEQ ID NO: 2496 - protein, 19 aa, Artificial Sequence
  GFR-binding peptide
  MOD_RES (14)..(15): Xaa is C or S
FYLVSIANLKTPAXXPKPV

SEQ ID NO: 2497 - protein, 20 aa, Artificial Sequence
  GFR-binding peptide
  MOD_RES (14)..(15): Xaa is C or S
FYLVSIANLQTPAXXPKPVT

SEQ ID NO: 2498 - protein, 18 aa, Artificial Sequence
  GFR-binding peptide
  MOD_RES (14)..(15): Xaa is C or S
FYLISIANLAQPVXXPAA

SEQ ID NO: 2499 - protein, 17 aa, Artificial Sequence
  GFR-binding peptide
  MOD_RES (14)..(15): Xaa is C or S
YYVVPLPELKTPAXXPK

SEQ ID NO: 2500 - protein, 15 aa, Artificial Sequence
  GFR-binding peptide
  MOD_RES (14)..(15): Xaa is C or S
FYLISIANLDQSVXX

SEQ ID NO: 2501 - protein, 12 aa, Artificial Sequence
  GFR-binding peptide
YYVIPLPELDQS

SEQ ID NO: 2502 - protein, 14 aa, Artificial Sequence
  GFR-binding peptide
  MOD_RES (14)..(14): Xaa is C or S
FYLISIANLRTPVX

SEQ ID NO: 2503 - protein, 17 aa, Artificial Sequence
  GFR-binding peptide
  MOD_RES (14)..(14): Xaa is C or S
FYLVSIANLKTPAXTPK

SEQ ID NO: 2504 - protein, 14 aa, Artificial Sequence
  GFR-binding peptide
  MOD_RES (14)..(14): Xaa is C or S
LYLISIASLRTPVX

SEQ ID NO: 2505 - protein, 12 aa, Artificial Sequence
  GFR-binding peptide
YYLITLPELRTP

SEQ ID NO: 2506 - protein, 13 aa, Artificial Sequence
  GFR-binding peptide
YYLITLPELDQSV

SEQ ID NO: 2507 - protein, 11 aa, Artificial Sequence
  GFR-binding peptide
YYLMTLPELET

SEQ ID NO: 2508 - protein, 8 aa, Artificial Sequence
  GFR-binding peptide
IFLISIPS

SEQ ID NO: 2509 - protein, 16 aa, Artificial Sequence
  GFR-binding peptide
  MOD_RES (14)..(15): Xaa is C or S
LYLVSIASLKTPAXXP

SEQ ID NO: 2510 - protein, 19 aa, Artificial Sequence
  GFR-binding peptide
  MOD_RES (14)..(15): Xaa is C or S
YYLITLPELRTPVXXTPPT

SEQ ID NO: 2511 - protein, 11 aa, Artificial Sequence
  GFR-binding peptide
FYLISIANLAQ

SEQ ID NO: 2512 - protein, 20 aa, Artificial Sequence
  GFR-binding peptide
  MOD_RES (14)..(15): Xaa is C or S
FYLISIANLDQSVXXPSASA

SEQ ID NO: 2513 - protein, 15 aa, Artificial Sequence
  GFR-binding peptide
  MOD_RES (14)..(15): Xaa is C or S
YYVIPLPELAQPVXX

SEQ ID NO: 2514 - protein, 11 aa, Artificial Sequence
  GFR-binding peptide
LYLVSIASLQT

SEQ ID NO: 2515 - protein, 13 aa, Artificial Sequence
  GFR-binding peptide
FYLISIANLDQSV

SEQ ID NO: 2516 - protein, 14 aa, Artificial Sequence
  GFR-binding peptide
  MOD_RES (14)..(14): Xaa is C or S
LYLVSIASLQTPAX

SEQ ID NO: 2517 - protein, 11 aa, Artificial Sequence
  GFR-binding peptide
LYLISIASLDQ

SEQ ID NO: 2518 - protein, 11 aa, Artificial Sequence
  GFR-binding peptide
IFLISIPSLDQ

SEQ ID NO: 2519 - protein, 18 aa, Artificial Sequence
  GFR-binding peptide
  MOD_RES (14)..(15): Xaa is C or S
IFLMSIPSLETPVXXAKP

SEQ ID NO: 2520 - protein, 10 aa, Artificial Sequence
  GFR-binding peptide
YYVIPLPELA

SEQ ID NO: 2521 - protein, 18 aa, Artificial Sequence
  GFR-binding peptide
  MOD_RES (14)..(15): Xaa is C or S
FYLISIANLDQPVXXPSA

SEQ ID NO: 2522 - protein, 16 aa, Artificial Sequence
  GFR-binding peptide
  MOD_RES (14)..(15): Xaa is C or S
FYLISIANLDQPVXXP

SEQ ID NO: 2523 - protein, 17 aa, Artificial Sequence
  GFR-binding peptide
  MOD_RES (14)..(15): Xaa is C or S
YYVMPLPELETPVXXAK

SEQ ID NO: 2524 - protein, 18 aa, Artificial Sequence
  GFR-binding peptide
  MOD_RES (14)..(15): Xaa is C or S
FYLISIANLRTPVXXTPP

SEQ ID NO: 2525 - protein, 11 aa, Artificial Sequence
  GFR-binding peptide
YYLVTLPELKT

SEQ ID NO: 2526 - protein, 15 aa, Artificial Sequence
  GFR-binding peptide
  MOD_RES (14)..(15): Xaa is C or S
YYVVPLPELQTPAXX

SEQ ID NO: 2527 - protein, 17 aa, Artificial Sequence
  GFR-binding peptide
  MOD_RES (14)..(15): Xaa is C or S
YYLVTLPELKTPAXXPK

SEQ ID NO: 2528 - protein, 10 aa, Artificial Sequence
  GFR-binding peptide
FYLVSIANLQ

SEQ ID NO: 2529 - protein, 15 aa, Artificial Sequence
  GFR-binding peptide
  MOD_RES (14)..(15): Xaa is C or S
YYLITLPELDQSVXX

SEQ ID NO: 2530 - protein, 19 aa, Artificial Sequence
  GFR-binding peptide
  MOD_RES (14)..(15): Xaa is C or S
IFLISIPSLDQSVXXPSAS

SEQ ID NO: 2531 - protein, 10 aa, Artificial Sequence
  GFR-binding peptide
IFLVSIPSLQ

SEQ ID NO: 2532 - protein, 14 aa, Artificial Sequence
  GFR-binding peptide
  MOD_RES (14)..(14): Xaa is C or S
YYVIPLPELDQPVX

SEQ ID NO: 2533 - protein, 19 aa, Artificial Sequence
  GFR-binding peptide
  MOD_RES (14)..(15): Xaa is C or S
FYLISIANLDQSVXXPSAS

SEQ ID NO: 2534 - protein, 13 aa, Artificial Sequence
  GFR-binding peptide
IFLISIPSLRTPV

SEQ ID NO: 2535 - protein, 18 aa, Artificial Sequence
  GFR-binding peptide
  MOD_RES (14)..(15): Xaa is C or S
YYLVTLPELQTPAXXPKP

SEQ ID NO: 2536 - protein, 15 aa, Artificial Sequence
  GFR-binding peptide
  MOD_RES (14)..(15): Xaa is C or S
IFLMSIPSLETPVXX

SEQ ID NO: 2537 - protein, 20 aa, Artificial Sequence
  GFR-binding peptide
  MOD_RES (14)..(15): Xaa is C or S
YYVVPLPELQTPAXXPKPVT

SEQ ID NO: 2538 - protein, 16 aa, Artificial Sequence
  GFR-binding peptide
  MOD_RES (14)..(15): Xaa is C or S
YYVVPLPELQTPAXXP

SEQ ID NO: 2539 - protein, 20 aa, Artificial Sequence
  GFR-binding peptide
  MOD_RES (14)..(15): Xaa is C or S
LYLVSIASLKTPAXXPKPVY

SEQ ID NO: 2540 - protein, 16 aa, Artificial Sequence
  GFR-binding peptide
  MOD_RES (14)..(15): Xaa is C or S
FYLISIANLAQPVXXP

SEQ ID NO: 2541 - protein, 10 aa, Artificial Sequence
  GFR-binding peptide
LYLVSIASLK

SEQ ID NO: 2542 - protein, 20 aa, Artificial Sequence
  GFR-binding peptide
  MOD_RES (14)..(15): Xaa is C or S
LYLMSIASLETPVXXAKPIS

SEQ ID NO: 2543 - protein, 9 aa, Artificial Sequence
  GFR-binding peptide
LYLMSIASL

SEQ ID NO: 2544 - protein, 17 aa, Artificial Sequence
  GFR-binding peptide
  MOD_RES (14)..(15): Xaa is C or S
LYLISIASLRTPVXXTP

SEQ ID NO: 2545 - protein, 19 aa, Artificial Sequence
  GFR-binding peptide
  MOD_RES (14)..(15): Xaa is C or S
FYLISIANLRTPVXXTPPT

SEQ ID NO: 2546 - protein, 15 aa, Artificial Sequence
  GFR-binding peptide
  MOD_RES (14)..(15): Xaa is C or S
LYLISIASLDQSVXX

SEQ ID NO: 2547 - protein, 18 aa, Artificial Sequence
  GFR-binding peptide
  MOD_RES (14)..(15): Xaa is C or S
YYLITLPELAQPVXXPAA

SEQ ID NO: 2548 - protein, 11 aa, Artificial Sequence
  GFR-binding peptide
YYVVPLPELKT

SEQ ID NO: 2549 - protein, 11 aa, Artificial Sequence
  GFR-binding peptide
YYLITLPELDQ

SEQ ID NO: 2550 - protein, 10 aa, Artificial Sequence
  GFR-binding peptide
LYLMSIASLE

SEQ ID NO: 2551 - protein, 20 aa, Artificial Sequence
  GFR-binding peptide
  MOD_RES (14)..(15): Xaa is C or S
IFLISIPSLRTPVXXTPPTS

SEQ ID NO: 2552 - protein, 19 aa, Artificial Sequence
  GFR-binding peptide
  MOD_RES (14)..(15): Xaa is C or S
YYVVPLPELQTPAXXPKPV

SEQ ID NO: 2553 - protein, 20 aa, Artificial Sequence
  GFR-binding peptide
  MOD_RES (14)..(15): Xaa is C or S
FYLISIANLRTPVXXTPPTS

SEQ ID NO: 2554 - protein, 15 aa, Artificial Sequence
  GFR-binding peptide
  MOD_RES (14)..(15): Xaa is C or S
YYLVTLPELQTPAXX

SEQ ID NO: 2555 - protein, 19 aa, Artificial Sequence
  GFR-binding peptide
  MOD_RES (14)..(15): Xaa is C or S
LYLMSIASLETPVXXAKPI

SEQ ID NO: 2556 - protein, 11 aa, Artificial Sequence
  GFR-binding peptide
IFLISIPSLRT

SEQ ID NO: 2557 - protein, 13 aa, Artificial Sequence
  GFR-binding peptide
FYLISIANLRTPV

SEQ ID NO: 2558 - protein, 8 aa, Artificial Sequence
  GFR-binding peptide
YYLITLPE

SEQ ID NO: 2559 - protein, 9 aa, Artificial Sequence
  GFR-binding peptide
YYVIPLPEL

SEQ ID NO: 2560 - protein, 17 aa, Artificial Sequence
  GFR-binding peptide
  MOD_RES (14)..(15): Xaa is C or S
IFLISIPSLDQPVXXPS

SEQ ID NO: 2561 - protein, 20 aa, Artificial Sequence
  GFR-binding peptide
  MOD_RES (14)..(15): Xaa is C or S
YYVIPLPELAQPVXXPAASA

SEQ ID NO: 2562 - protein, 19 aa, Artificial Sequence
  GFR-binding peptide
  MOD_RES (14)..(15): Xaa is C or S
LYLISIASLAQPVXXPAAS

SEQ ID NO: 2563 - protein, 15 aa, Artificial Sequence
  GFR-binding peptide
  MOD_RES (14)..(15): Xaa is C or S
FYLMSIANLETPVXX

SEQ ID NO: 2564 - protein, 14 aa, Artificial Sequence
  GFR-binding peptide
  MOD_RES (14)..(14): Xaa is C or S
YYLITLPELDQPVX

SEQ ID NO: 2565 - protein, 20 aa, Artificial Sequence
  GFR-binding peptide
  MOD_RES (14)..(15): Xaa is C or S
LYLISIASLDQPVXXPSASA

SEQ ID NO: 2566 - protein, 16 aa, Artificial Sequence
  GFR-binding peptide
  MOD_RES (14)..(15): Xaa is C or S
IFLISIPSLAQPVXXP

SEQ ID NO: 2567 - protein, 12 aa, Artificial Sequence
  GFR-binding peptide
YYLITLPELDQP

SEQ ID NO: 2568 - protein, 18 aa, Artificial Sequence
  GFR-binding peptide
  MOD_RES (14)..(15): Xaa is C or S
YYVIPLPELDQPVXXPSA

SEQ ID NO: 2569 - protein, 19 aa, Artificial Sequence
  GFR-binding peptide
  MOD_RES (14)..(15): Xaa is C or S
IFLISIPSLRTPVXXTPPT

SEQ ID NO: 2570 - protein, 15 aa, Artificial Sequence
  GFR-binding peptide
  MOD_RES (14)..(14): Xaa is C or S
LYLVSIASLKTPAXT

SEQ ID NO: 2571 - protein, 17 aa, Artificial Sequence
  GFR-binding peptide
  MOD_RES (14)..(15): Xaa is C or S
YYVIPLPELAQPVXXPA

SEQ ID NO: 2572 - protein, 12 aa, Artificial Sequence
  GFR-binding peptide
LYLVSIASLKTP

SEQ ID NO: 2573 - protein, 12 aa, Artificial Sequence
  GFR-binding peptide
IFLVSIPSLQTP

SEQ ID NO: 2574 - protein, 15 aa, Artificial Sequence
  GFR-binding peptide
  MOD_RES (14)..(15): Xaa is C or S
LYLISIASLRTPVXX

SEQ ID NO: 2575 - protein, 12 aa, Artificial Sequence
  GFR-binding peptide
IFLVSIPSLKTP

SEQ ID NO: 2576 - protein, 12 aa, Artificial Sequence
  GFR-binding peptide
FYLVSIANLQTP

SEQ ID NO: 2577 - protein, 13 aa, Artificial Sequence
  GFR-binding peptide
FYLMSIANLETPV

SEQ ID NO: 2578 - protein, 12 aa, Artificial Sequence
  GFR-binding peptide
YYLITLPELAQP

SEQ ID NO: 2579 - protein, 19 aa, Artificial Sequence
  GFR-binding peptide
  MOD_RES (14)..(15): Xaa is C or S
YYLITLPELDQPVXXPSAS

SEQ ID NO: 2580 - protein, 18 aa, Artificial Sequence
  GFR-binding peptide
  MOD_RES (14)..(15): Xaa is C or S
YYLITLPELDQSVXXPSA

SEQ ID NO: 2581 - protein, 15 aa, Artificial Sequence
  GFR-binding peptide
  MOD_RES (14)..(15): Xaa is C or S
IFLISIPSLRTPVXX

SEQ ID NO: 2582 - protein, 14 aa, Artificial Sequence
  GFR-binding peptide
  MOD_RES (14)..(14): Xaa is C or S
YYVIPLPELAQPVX

SEQ ID NO: 2583 - protein, 15 aa, Artificial Sequence
  GFR-binding peptide
  MOD_RES (14)..(15): Xaa is C or S
FYLISIANLRTPVXX

SEQ ID NO: 2584 - protein, 18 aa, Artificial Sequence
  GFR-binding peptide
  MOD_RES (14)..(14): Xaa is C or S
YYVVPLPELKTPAXTPKT

SEQ ID NO: 2585 - protein, 11 aa, Artificial Sequence
  GFR-binding peptide
FYLISIANLRT

SEQ ID NO: 2586 - protein, 9 aa, Artificial Sequence
  GFR-binding peptide
YYLITLPEL

SEQ ID NO: 2587 - protein, 15 aa, Artificial Sequence
  GFR-binding peptide
  MOD_RES (14)..(15): Xaa is C or S
YYLITLPELAQPVXX

SEQ ID NO: 2588 - protein, 13 aa, Artificial Sequence
  GFR-binding peptide
YYLVTLPELKTPA

SEQ ID NO: 2589 - protein, 20 aa, Artificial Sequence
  GFR-binding peptide
  MOD_RES (14)..(15): Xaa is C or S
YYVMPLPELETPVXXAKPIK

SEQ ID NO: 2590 - protein, 10 aa, Artificial Sequence
  GFR-binding peptide
YYLITLPELA

SEQ ID NO: 2591 - protein, 14 aa, Artificial Sequence
  GFR-binding peptide
  MOD_RES (14)..(14): Xaa is C or S
YYLITLPELAQPVX

SEQ ID NO: 2592 - protein, 16 aa, Artificial Sequence
  GFR-binding peptide
  MOD_RES (14)..(15): Xaa is C or S
FYLISIANLDQSVXXP

SEQ ID NO: 2593 - protein, 17 aa, Artificial Sequence
  GFR-binding peptide
  MOD_RES (14)..(15): Xaa is C or S
IFLISIPSLDQSVXXPS

SEQ ID NO: 2594 - protein, 14 aa, Artificial Sequence
  GFR-binding peptide
  MOD_RES (14)..(14): Xaa is C or S
FYLMSIANLETPVX

SEQ ID NO: 2595 - protein, 17 aa, Artificial Sequence
  GFR-binding peptide
  MOD_RES (14)..(15): Xaa is C or S
LYLISIASLDQSVXXPS

SEQ ID NO: 2596 - protein, 20 aa, Artificial Sequence
  GFR-binding peptide
  MOD_RES (14)..(15): Xaa is C or S
FYLISIANLDQPVXXPSASA

SEQ ID NO: 2597 - protein, 12 aa, Artificial Sequence
  GFR-binding peptide
LYLVSIASLQTP

SEQ ID NO: 2598 - protein, 15 aa, Artificial Sequence
  GFR-binding peptide
  MOD_RES (14)..(15): Xaa is C or S
YYLVTLPELKTPAXX

SEQ ID NO: 2599 - protein, 20 aa, Artificial Sequence
  GFR-binding peptide
  MOD_RES (14)..(14): Xaa is C or S
YYLVTLPELKTPAXTPKTVH

SEQ ID NO: 2600 - protein, 12 aa, Artificial Sequence
  GFR-binding peptide
YYVIPLPELDQP

SEQ ID NO: 2601 - protein, 14 aa, Artificial Sequence
  GFR-binding peptide
  MOD_RES (14)..(14): Xaa is C or S
YYVVPLPELKTPAX

SEQ ID NO: 2602 - protein, 13 aa, Artificial Sequence
  GFR-binding peptide
YYLITLPELDQPV

SEQ ID NO: 2603 - protein, 16 aa, Artificial Sequence
  GFR-binding peptide
  MOD_RES (14)..(15): Xaa is C or S
YYVIPLPELRTPVXXT

SEQ ID NO: 2604 - protein, 18 aa, Artificial Sequence
  GFR-binding peptide
  MOD_RES (14)..(15): Xaa is C or S
YYVVPLPELQTPAXXPKP

SEQ ID NO: 2605 - protein, 16 aa, Artificial Sequence
  GFR-binding peptide
  MOD_RES (14)..(15): Xaa is C or S
YYLVTLPELQTPAXXP

SEQ ID NO: 2606 - protein, 17 aa, Artificial Sequence
  GFR-binding peptide
  MOD_RES (14)..(15): Xaa is C or S
FYLISIANLRTPVXXTP

SEQ ID NO: 2607 - protein, 16 aa, Artificial Sequence
  GFR-binding peptide
  MOD_RES (14)..(15): Xaa is C or S
LYLISIASLDQSVXXP

SEQ ID NO: 2608 - protein, 19 aa, Artificial Sequence
  GFR-binding peptide
  MOD_RES (14)..(14): Xaa is C or S
YYVVPLPELKTPAXTPKTV

SEQ ID NO: 2609 - protein, 13 aa, Artificial Sequence
  GFR-binding peptide
YYVVPLPELQTPA

SEQ ID NO: 2610 - protein, 16 aa, Artificial Sequence
  GFR-binding peptide
  MOD_RES (14)..(15): Xaa is C or S
IFLISIPSLDQSVXXP

SEQ ID NO: 2611 - protein, 16 aa, Artificial Sequence
  GFR-binding peptide
  MOD_RES (14)..(15): Xaa is C or S
YYVMPLPELETPVXXA

SEQ ID NO: 2612 - protein, 12 aa, Artificial Sequence
  GFR-binding peptide
IFLMSIPSLETP

SEQ ID NO: 2613 - protein, 18 aa, Artificial Sequence
  GFR-binding peptide
  MOD_RES (14)..(15): Xaa is C or S
IFLISIPSLRTPVXXTPP

SEQ ID NO: 2614 - protein, 18 aa, Artificial Sequence
  GFR-binding peptide
  MOD_RES (14)..(15): Xaa is C or S
LYLISIASLRTPVXXTPP

SEQ ID NO: 2615 - protein, 12 aa, Artificial Sequence
  GFR-binding peptide
FYLVSIANLKTP

SEQ ID NO: 2616 - protein, 14 aa, Artificial Sequence
  GFR-binding peptide
  MOD_RES (14)..(14): Xaa is C or S
IFLMSIPSLETPVX

SEQ ID NO: 2617 - protein, 17 aa, Artificial Sequence
  GFR-binding peptide
  MOD_RES (14)..(15): Xaa is C or S
FYLISIANLDQSVXXPS

SEQ ID NO: 2618 - protein, 12 aa, Artificial Sequence
  GFR-binding peptide
LYLMSIASLETP

SEQ ID NO: 2619 - protein, 14 aa, Artificial Sequence
  GFR-binding peptide
  MOD_RES (14)..(14): Xaa is C or S
LYLMSIASLETPVX

SEQ ID NO: 2620 - protein, 13 aa, Artificial Sequence
  GFR-binding peptide
TQVQLRSVKVAKV

SEQ ID NO: 2621 - protein, 13 aa, Artificial Sequence
  GFR-binding peptide
VPTGQRPVQMRKI

SEQ ID NO: 2622 - protein, 18 aa, Artificial Sequence
  GFR-binding peptide
  MOD_RES (3)..(3): Xaa is C or S
VQXRPTQVQLSNITVQIM

SEQ ID NO: 2623 - protein, 11 aa, Artificial Sequence
  GFR-binding peptide
TEERPVQMRKI

SEQ ID NO: 2624 - protein, 14 aa, Artificial Sequence
  GFR-binding peptide
PSRVHHRPVQVRKI

SEQ ID NO: 2625 - protein, 12 aa, Artificial Sequence
  GFR-binding peptide
RVHHSNITVQIM

SEQ ID NO: 2626 - protein, 19 aa, Artificial Sequence
  GFR-binding peptide
  MOD_RES (6)..(6): Xaa is C or S
DEGLEXVPTGQRPVQMRKI

SEQ ID NO: 2627 - protein, 14 aa, Artificial Sequence
  GFR-binding peptide
  MOD_RES (1)..(1): Xaa is C or S
XVPTEERSVKMAKV

SEQ ID NO: 2628 - protein, 10 aa, Artificial Sequence
  GFR-binding peptide
QLSNITVQIM

SEQ ID NO: 2629 - protein, 15 aa, Artificial Sequence
  GFR-binding peptide
RPTQVQLSNITVQIM

SEQ ID NO: 2630 - protein, 15 aa, Artificial Sequence
  GFR-binding peptide
RPTQVQLRSVKVAKV

SEQ ID NO: 2631 - protein, 9 aa, Artificial Sequence
  GFR-binding peptide
QRPVQMRKI

SEQ ID NO: 2632 - protein, 20 aa, Artificial Sequence
  GFR-binding peptide
  MOD_RES (5)..(5): Xaa is C or S
RNVQXRPTQVQLSNITVQIM

SEQ ID NO: 2633 - protein, 15 aa, Artificial Sequence
  GFR-binding peptide
QPSRVHHRPVQVRKI

SEQ ID NO: 2634 - protein, 14 aa, Artificial Sequence
  GFR-binding peptide
  MOD_RES (1)..(1): Xaa is C or S
XVPTGQRPVQMRKI

SEQ ID NO: 2635 - protein, 16 aa, Artificial Sequence
  GFR-binding peptide
  MOD_RES (3)..(3): Xaa is C or S
LEXVPTGQRSVKMAKV

SEQ ID NO: 2636 - protein, 19 aa, Artificial Sequence
  GFR-binding peptide
  MOD_RES (4)..(4): Xaa is C or S
SVKXQPSRVHHRPVQVRKI

SEQ ID NO: 2637 - protein, 11 aa, Artificial Sequence
  GFR-binding peptide
TGQRSVKMAKV

SEQ ID NO: 2638 - protein, 17 aa, Artificial Sequence
  GFR-binding peptide
  MOD_RES (4)..(4): Xaa is C or S
GLEXVPTEERPVQMRKI

SEQ ID NO: 2639 - protein, 13 aa, Artificial Sequence
  GFR-binding peptide
TQVQLSNITVQIM

SEQ ID NO: 2640 - protein, 19 aa, Artificial Sequence
  GFR-binding peptide
  MOD_RES (6)..(6): Xaa is C or S
DEGLEXVPTEERSVKMAKV

SEQ ID NO: 2641 - protein, 13 aa, Artificial Sequence
  GFR-binding peptide
VPTEERSVKMAKV

SEQ ID NO: 2642 - protein, 11 aa, Artificial Sequence
  GFR-binding peptide
VQLSNITVQIM

SEQ ID NO: 2643 - protein, 20 aa, Artificial Sequence
  GFR-binding peptide
  MOD_RES (7)..(7): Xaa is C or S
NDEGLEXVPTEERSVKMAKV

SEQ ID NO: 2644 - protein, 16 aa, Artificial Sequence
  GFR-binding peptide
  MOD_RES (3)..(3): Xaa is C or S
LEXVPTEERPVQMRKI

SEQ ID NO: 2645 - protein, 18 aa, Artificial Sequence
  GFR-binding peptide
  MOD_RES (3)..(3): Xaa is C or S
VQXRPTQVQLRSVKVAKV

SEQ ID NO: 2646 - protein, 17 aa, Artificial Sequence
  GFR-binding peptide
  MOD_RES (2)..(2): Xaa is C or S
KXQPSRVHHSNITVQIM

SEQ ID NO: 2647 - protein, 16 aa, Artificial Sequence
  GFR-binding peptide
  MOD_RES (1)..(1): Xaa is C or S
XRPTQVQLSNITVQIM

SEQ ID NO: 2648 - protein, 14 aa, Artificial Sequence
  GFR-binding peptide
PSRVHHSNITVQIM

SEQ ID NO: 2649 - protein, 12 aa, Artificial Sequence
  GFR-binding peptide
RVHHRPVQVRKI

SEQ ID NO: 2650 - protein, 10 aa, Artificial Sequence
  GFR-binding peptide
HHRPVQVRKI

SEQ ID NO: 2651 - protein, 15 aa, Artificial Sequence
  GFR-binding peptide
  MOD_RES (2)..(2): Xaa is C or S
EXVPTGQRSVKMAKV

SEQ ID NO: 2652 - protein, 10 aa, Artificial Sequence
  GFR-binding peptide
GQRSVKMAKV

SEQ ID NO: 2653 - protein, 12 aa, Artificial Sequence
  GFR-binding peptide
PTEERPVQMRKI

SEQ ID NO: 2654 - protein, 15 aa, Artificial Sequence
  GFR-binding peptide
  MOD_RES (2)..(2): Xaa is C or S
EXVPTEERSVKMAKV

SEQ ID NO: 2655 - protein, 10 aa, Artificial Sequence
  GFR-binding peptide
EERSVKMAKV

SEQ ID NO: 2656 - protein, 14 aa, Artificial Sequence
  GFR-binding peptide
  MOD_RES (1)..(1): Xaa is C or S
XVPTEERPVQMRKI

SEQ ID NO: 2657 - protein, 19 aa, Artificial Sequence
  GFR-binding peptide
  MOD_RES (6)..(6): Xaa is C or S
DEGLEXVPTGQRSVKMAKV

SEQ ID NO: 2658 - protein, 13 aa, Artificial Sequence
  GFR-binding peptide
SRVHHSNITVQIM

SEQ ID NO: 2659 - protein, 15 aa, Artificial Sequence
  GFR-binding peptide
QPSRVHHSNITVQIM

SEQ ID NO: 2660 - protein, 12 aa, Artificial Sequence
  GFR-binding peptide
QVQLRSVKVAKV

SEQ ID NO: 2661 - protein, 9 aa, Artificial Sequence
  GFR-binding peptide
QRSVKMAKV

SEQ ID NO: 2662 - protein, 9 aa, Artificial Sequence
  GFR-binding peptide
LRSVKVAKV

SEQ ID NO: 2663 - protein, 10 aa, Artificial Sequence
  GFR-binding peptide
QLRSVKVAKV

SEQ ID NO: 2664 - protein, 20 aa, Artificial Sequence
  GFR-binding peptide
  MOD_RES (5)..(5): Xaa is C or S
SSVKXQPSRVHHSNITVQIM

SEQ ID NO: 2665 - protein, 19 aa, Artificial Sequence
  GFR-binding peptide
  MOD_RES (4)..(4): Xaa is C or S
NVQXRPTQVQLRSVKVAKV

SEQ ID NO: 2666 - protein, 14 aa, Artificial Sequence
  GFR-binding peptide
  MOD_RES (1)..(1): Xaa is C or S
XVPTGQRSVKMAKV

SEQ ID NO: 2667 - protein, 19 aa, Artificial Sequence
  GFR-binding peptide
  MOD_RES (6)..(6): Xaa is C or S
DEGLEXVPTEERPVQMRKI

SEQ ID NO: 2668 - protein, 11 aa, Artificial Sequence
  GFR-binding peptide
VHHSNITVQIM

SEQ ID NO: 2669 - protein, 11 aa, Artificial Sequence
  GFR-binding peptide
TGQRPVQMRKI

SEQ ID NO: 2670 - protein, 16 aa, Artificial Sequence
  GFR-binding peptide
  MOD_RES (3)..(3): Xaa is C or S
LEXVPTGQRPVQMRKI

SEQ ID NO: 2671 - protein, 13 aa, Artificial Sequence
  GFR-binding peptide
VPTEERPVQMRKI

SEQ ID NO: 2672 - protein, 18 aa, Artificial Sequence
  GFR-binding peptide
  MOD_RES (3)..(3): Xaa is C or S
VKXQPSRVHHSNITVQIM

SEQ ID NO: 2673 - protein, 14 aa, Artificial Sequence
  GFR-binding peptide
PTQVQLSNITVQIM

SEQ ID NO: 2674 - protein, 10 aa, Artificial Sequence
  GFR-binding peptide
HHSNITVQIM

SEQ ID NO: 2675 - protein, 13 aa, Artificial Sequence
  GFR-binding peptide
VPTGQRSVKMAKV

SEQ ID NO: 2676 - protein, 18 aa, Artificial Sequence
  GFR-binding peptide
  MOD_RES (5)..(5): Xaa is C or S
EGLEXVPTGQRSVKMAKV

SEQ ID NO: 2677 - protein, 16 aa, Artificial Sequence
  GFR-binding peptide
  MOD_RES (1)..(1): Xaa is C or S
XRPTQVQLRSVKVAKV

SEQ ID NO: 2678 - protein, 14 aa, Artificial Sequence
  GFR-binding peptide
PTQVQLRSVKVAKV

SEQ ID NO: 2679 - protein, 13 aa, Artificial Sequence
  GFR-binding peptide
SRVHHRPVQVRKI

SEQ ID NO: 2680 - protein, 12 aa, Artificial Sequence
  GFR-binding peptide
PTGQRPVQMRKI

SEQ ID NO: 2681 - protein, 20 aa, Artificial Sequence
  GFR-binding peptide
  MOD_RES (7)..(7): Xaa is C or S
NDEGLEXVPTGQRSVKMAKV

SEQ ID NO: 2682 - protein, 17 aa, Artificial Sequence
  GFR-binding peptide
  MOD_RES (2)..(2): Xaa is C or S
QXRPTQVQLSNITVQIM

SEQ ID NO: 2683 - protein, 17 aa, Artificial Sequence
  GFR-binding peptide
  MOD_RES (4)..(4): Xaa is C or S
GLEXVPTGQRSVKMAKV

SEQ ID NO: 2684 - protein, 11 aa, Artificial Sequence
  GFR-binding peptide
TEERSVKMAKV

SEQ ID NO: 2685 - protein, 18 aa, Artificial Sequence
  GFR-binding peptide
  MOD_RES (5)..(5): Xaa is C or S
EGLEXVPTEERPVQMRKI

SEQ ID NO: 2686 - protein, 11 aa, Artificial Sequence
  GFR-binding peptide
VHHRPVQVRKI

SEQ ID NO: 2687 - protein, 9 aa, Artificial Sequence
  GFR-binding peptide
ERSVKMAKV

SEQ ID NO: 2688 - protein, 18 aa, Artificial Sequence
  GFR-binding peptide
  MOD_RES (3)..(3): Xaa is C or S
VKXQPSRVHHRPVQVRKI

SEQ ID NO: 2689 - protein, 18 aa, Artificial Sequence
  GFR-binding peptide
  MOD_RES (5)..(5): Xaa is C or S
EGLEXVPTGQRPVQMRKI

SEQ ID NO: 2690 - protein, 20 aa, Artificial Sequence
  GFR-binding peptide
  MOD_RES (7)..(7): Xaa is C or S
NDEGLEXVPTGQRPVQMRKI

SEQ ID NO: 2691 - protein, 17 aa, Artificial Sequence
  GFR-binding peptide
  MOD_RES (2)..(2): Xaa is C or S
QXRPTQVQLRSVKVAKV

SEQ ID NO: 2692 - protein, 11 aa, Artificial Sequence
  GFR-binding peptide
VQLRSVKVAKV

SEQ ID NO: 2693 - protein, 12 aa, Artificial Sequence
  GFR-binding peptide
PTEERSVKMAKV

SEQ ID NO: 2694 - protein, 17 aa, Artificial Sequence
  GFR-binding peptide
  MOD_RES (2)..(2): Xaa is C or S
KXQPSRVHHRPVQVRKI

SEQ ID NO: 2695 - protein, 15 aa, Artificial Sequence
  GFR-binding peptide
  MOD_RES (2)..(2): Xaa is C or S
EXVPTGQRPVQMRKI

SEQ ID NO: 2696 - protein, 10 aa, Artificial Sequence
  GFR-binding peptide
GQRPVQMRKI

SEQ ID NO: 2697 - protein, 20 aa, Artificial Sequence
  GFR-binding peptide
  MOD_RES (7)..(7): Xaa is C or S
NDEGLEXVPTEERPVQMRKI

SEQ ID NO: 2698 - protein, 17 aa, Artificial Sequence
  GFR-binding peptide
  MOD_RES (4)..(4): Xaa is C or S
GLEXVPTEERSVKMAKV

SEQ ID NO: 2699 - protein, 17 aa, Artificial Sequence
  GFR-binding peptide
  MOD_RES (4)..(4): Xaa is C or S
GLEXVPTGQRPVQMRKI

SEQ ID NO: 2700 - protein, 9 aa, Artificial Sequence
  GFR-binding peptide
ERPVQMRKI

SEQ ID NO: 2701 - protein, 19 aa, Artificial Sequence
  GFR-binding peptide
  MOD_RES (4)..(4): Xaa is C or S
SVKXQPSRVHHSNITVQIM

SEQ ID NO: 2702 - protein, 9 aa, Artificial Sequence
  GFR-binding peptide
LSNITVQIM

SEQ ID NO: 2703 - protein, 16 aa, Artificial Sequence
  GFR-binding peptide
  MOD_RES (3)..(3): Xaa is C or S
LEXVPTEERSVKMAKV

SEQ ID NO: 2704 - protein, 18 aa, Artificial Sequence
  GFR-binding peptide
  MOD_RES (5)..(5): Xaa is C or S
EGLEXVPTEERSVKMAKV

SEQ ID NO: 2705 - protein, 16 aa, Artificial Sequence
  GFR-binding peptide
  MOD_RES (1)..(1): Xaa is C or S
XQPSRVHHRPVQVRKI

SEQ ID NO: 2706 - protein, 19 aa, Artificial Sequence
  GFR-binding peptide
  MOD_RES (4)..(4): Xaa is C or S
NVQXRPTQVQLSNITVQIM

SEQ ID NO: 2707 - protein, 9 aa, Artificial Sequence
  GFR-binding peptide
HRPVQVRKI

SEQ ID NO: 2708 - protein, 16 aa, Artificial Sequence
  GFR-binding peptide
  MOD_RES (1)..(1): Xaa is C or S
XQPSRVHHSNITVQIM

SEQ ID NO: 2709 - protein, 9 aa, Artificial Sequence
  GFR-binding peptide
HSNITVQIM

SEQ ID NO: 2710 - protein, 15 aa, Artificial Sequence
  GFR-binding peptide
  MOD_RES (2)..(2): Xaa is C or S
EXVPTEERPVQMRKI

SEQ ID NO: 2711 - protein, 10 aa, Artificial Sequence
  GFR-binding peptide
EERPVQMRKI

SEQ ID NO: 2712 - protein, 12 aa, Artificial Sequence
  GFR-binding peptide
PTGQRSVKMAKV

SEQ ID NO: 2713 - protein, 12 aa, Artificial Sequence
  GFR-binding peptide
QVQLSNITVQIM

SEQ ID NO: 2714 - protein, 13 aa, Artificial Sequence
  GFR-binding peptide
TQVQLRSVKVAKV

SEQ ID NO: 2715 - protein, 13 aa, Artificial Sequence
  GFR-binding peptide
VPTGQRPVQMRKI

SEQ ID NO: 2716 - protein, 18 aa, Artificial Sequence
  GFR-binding peptide
  MOD_RES (3)..(3): Xaa is C or S
VQXRPTQVQLSNITVQIM

SEQ ID NO: 2717 - protein, 11 aa, Artificial Sequence
  GFR-binding peptide
TEERPVQMRKI

SEQ ID NO: 2718 - protein, 14 aa, Artificial Sequence
  GFR-binding peptide
PSRVHHRPVQVRKI

SEQ ID NO: 2719 - protein, 12 aa, Artificial Sequence
  GFR-binding peptide
RVHHSNITVQIM

SEQ ID NO: 2720 - protein, 19 aa, Artificial Sequence
  GFR-binding peptide
  MOD_RES (6)..(6): Xaa is C or S
DEGLEXVPTGQRPVQMRKI

SEQ ID NO: 2721 - protein, 14 aa, Artificial Sequence
  GFR-binding peptide
  MOD_RES (1)..(1): Xaa is C or S
XVPTEERSVKMAKV

SEQ ID NO: 2722 - protein, 10 aa, Artificial Sequence
  GFR-binding peptide
QLSNITVQIM

SEQ ID NO: 2723 - protein, 15 aa, Artificial Sequence
  GFR-binding peptide
RPTQVQLSNITVQIM

SEQ ID NO: 2724 - protein, 15 aa, Artificial Sequence
  GFR-binding peptide
RPTQVQLRSVKVAKV

SEQ ID NO: 2725 - protein, 9 aa, Artificial Sequence
  GFR-binding peptide
QRPVQMRKI

SEQ ID NO: 2726 - protein, 20 aa, Artificial Sequence
  GFR-binding peptide
  MOD_RES (5)..(5): Xaa is C or S
RNVQXRPTQVQLSNITVQIM

SEQ ID NO: 2727 - protein, 15 aa, Artificial Sequence
  GFR-binding peptide
QPSRVHHRPVQVRKI

SEQ ID NO: 2728 - protein, 14 aa, Artificial Sequence
  GFR-binding peptide
  MOD_RES (1)..(1): Xaa is C or S
XVPTGQRPVQMRKI

SEQ ID NO: 2729 - protein, 16 aa, Artificial Sequence
  GFR-binding peptide
  MOD_RES (3)..(3): Xaa is C or S
LEXVPTGQRSVKMAKV

SEQ ID NO: 2730 - protein, 19 aa, Artificial Sequence
  GFR-binding peptide
  MOD_RES (4)..(4): Xaa is C or S
SVKXQPSRVHHRPVQVRKI

SEQ ID NO: 2731 - protein, 11 aa, Artificial Sequence
  GFR-binding peptide
TGQRSVKMAKV

SEQ ID NO: 2732 - protein, 17 aa, Artificial Sequence
  GFR-binding peptide
  MOD_RES (4)..(4): Xaa is C or S
GLEXVPTEERPVQMRKI

SEQ ID NO: 2733 - protein, 13 aa, Artificial Sequence
  GFR-binding peptide
TQVQLSNITVQIM

SEQ ID NO: 2734 - protein, 19 aa, Artificial Sequence
  GFR-binding peptide
  MOD_RES (6)..(6): Xaa is C or S
DEGLEXVPTEERSVKMAKV

SEQ ID NO: 2735 - protein, 13 aa, Artificial Sequence
  GFR-binding peptide
VPTEERSVKMAKV

SEQ ID NO: 2736 - protein, 11 aa, Artificial Sequence
  GFR-binding peptide
VQLSNITVQIM

SEQ ID NO: 2737 - protein, 20 aa, Artificial Sequence
  GFR-binding peptide
  MOD_RES (7)..(7): Xaa is C or S
NDEGLEXVPTEERSVKMAKV

SEQ ID NO: 2738 - protein, 16 aa, Artificial Sequence
  GFR-binding peptide
  MOD_RES (3)..(3): Xaa is C or S
LEXVPTEERPVQMRKI

SEQ ID NO: 2739 - protein, 18 aa, Artificial Sequence
  GFR-binding peptide
  MOD_RES (3)..(3): Xaa is C or S
VQXRPTQVQLRSVKVAKV

SEQ ID NO: 2740 - protein, 17 aa, Artificial Sequence
  GFR-binding peptide
  MOD_RES (2)..(2): Xaa is C or S
KXQPSRVHHSNITVQIM

SEQ ID NO: 2741 - protein, 16 aa, Artificial Sequence
  GFR-binding peptide
  MOD_RES (1)..(1): Xaa is C or S
XRPTQVQLSNITVQIM

SEQ ID NO: 2742 - protein, 14 aa, Artificial Sequence
  GFR-binding peptide
PSRVHHSNITVQIM

SEQ ID NO: 2743 - protein, 12 aa, Artificial Sequence
  GFR-binding peptide
RVHHRPVQVRKI

SEQ ID NO: 2744 - protein, 10 aa, Artificial Sequence
  GFR-binding peptide
HHRPVQVRKI

SEQ ID NO: 2745 - protein, 15 aa, Artificial Sequence
  GFR-binding peptide
  MOD_RES (2)..(2): Xaa is C or S
EXVPTGQRSVKMAKV

SEQ ID NO: 2746 - protein, 10 aa, Artificial Sequence
  GFR-binding peptide
GQRSVKMAKV

SEQ ID NO: 2747 - protein, 12 aa, Artificial Sequence
  GFR-binding peptide
PTEERPVQMRKI

SEQ ID NO: 2748 - protein, 15 aa, Artificial Sequence
  GFR-binding peptide
  MOD_RES (2)..(2): Xaa is C or S
EXVPTEERSVKMAKV

SEQ ID NO: 2749 - protein, 10 aa, Artificial Sequence
  GFR-binding peptide
EERSVKMAKV

SEQ ID NO: 2750 - protein, 14 aa, Artificial Sequence
  GFR-binding peptide
  MOD_RES (1)..(1): Xaa is C or S
XVPTEERPVQMRKI

SEQ ID NO: 2751 - protein, 19 aa, Artificial Sequence
  GFR-binding peptide
  MOD_RES (6)..(6): Xaa is C or S
DEGLEXVPTGQRSVKMAKV

SEQ ID NO: 2752 - protein, 13 aa, Artificial Sequence
  GFR-binding peptide
SRVHHSNITVQIM

SEQ ID NO: 2753 - protein, 15 aa, Artificial Sequence
  GFR-binding peptide
QPSRVHHSNITVQIM

SEQ ID NO: 2754 - protein, 12 aa, Artificial Sequence
  GFR-binding peptide
QVQLRSVKVAKV

SEQ ID NO: 2755 - protein, 9 aa, Artificial Sequence
  GFR-binding peptide
QRSVKMAKV

SEQ ID NO: 2756 - protein, 9 aa, Artificial Sequence
  GFR-binding peptide
LRSVKVAKV

SEQ ID NO: 2757 - protein, 10 aa, Artificial Sequence
  GFR-binding peptide
QLRSVKVAKV

SEQ ID NO: 2758 - protein, 20 aa, Artificial Sequence
  GFR-binding peptide
  MOD_RES (5)..(5): Xaa is C or S
SSVKXQPSRVHHSNITVQIM

SEQ ID NO: 2759 - protein, 19 aa, Artificial Sequence
  GFR-binding peptide
  MOD_RES (4)..(4): Xaa is C or S
NVQXRPTQVQLRSVKVAKV

SEQ ID NO: 2760 - protein, 14 aa, Artificial Sequence
  GFR-binding peptide
  MOD_RES (1)..(1): Xaa is C or S
XVPTGQRSVKMAKV

SEQ ID NO: 2761 - protein, 19 aa, Artificial Sequence
  GFR-binding peptide
  MOD_RES (6)..(6): Xaa is C or S
DEGLEXVPTEERPVQMRKI

SEQ ID NO: 2762 - protein, 11 aa, Artificial Sequence
  GFR-binding peptide
VHHSNITVQIM

SEQ ID NO: 2763 - protein, 11 aa, Artificial Sequence
  GFR-binding peptide
TGQRPVQMRKI

SEQ ID NO: 2764 - protein, 16 aa, Artificial Sequence
  GFR-binding peptide
  MOD_RES (3)..(3): Xaa is C or S
LEXVPTGQRPVQMRKI

SEQ ID NO: 2765 - protein, 13 aa, Artificial Sequence
  GFR-binding peptide
VPTEERPVQMRKI

SEQ ID NO: 2766 - protein, 18 aa, Artificial Sequence
  GFR-binding peptide
  MOD_RES (3)..(3): Xaa is C or S
VKXQPSRVHHSNITVQIM

SEQ ID NO: 2767 - protein, 14 aa, Artificial Sequence
  GFR-binding peptide
PTQVQLSNITVQIM

SEQ ID NO: 2768 - protein, 10 aa, Artificial Sequence
  GFR-binding peptide
HHSNITVQIM

SEQ ID NO: 2769 - protein, 13 aa, Artificial Sequence
  GFR-binding peptide
VPTGQRSVKMAKV

SEQ ID NO: 2770 - protein, 18 aa, Artificial Sequence
  GFR-binding peptide
  MOD_RES (5)..(5): Xaa is C or S
EGLEXVPTGQRSVKMAKV

SEQ ID NO: 2771 - protein, 16 aa, Artificial Sequence
  GFR-binding peptide
  MOD_RES (1)..(1): Xaa is C or S
XRPTQVQLRSVKVAKV

SEQ ID NO: 2772 - protein, 14 aa, Artificial Sequence
  GFR-binding peptide
PTQVQLRSVKVAKV

SEQ ID NO: 2773 - protein, 13 aa, Artificial Sequence
  GFR-binding peptide
SRVHHRPVQVRKI

SEQ ID NO: 2774 - protein, 12 aa, Artificial Sequence
  GFR-binding peptide
PTGQRPVQMRKI

SEQ ID NO: 2775 - protein, 20 aa, Artificial Sequence
  GFR-binding peptide
  MOD_RES (7)..(7): Xaa is C or S
NDEGLEXVPTGQRSVKMAKV

SEQ ID NO: 2776 - protein, 17 aa, Artificial Sequence
  GFR-binding peptide
  MOD_RES (2)..(2): Xaa is C or S
QXRPTQVQLSNITVQIM

SEQ ID NO: 2777 - protein, 17 aa, Artificial Sequence
  GFR-binding peptide
  MOD_RES (4)..(4): Xaa is C or S
GLEXVPTGQRSVKMAKV

SEQ ID NO: 2778 - protein, 11 aa, Artificial Sequence
  GFR-binding peptide
TEERSVKMAKV

SEQ ID NO: 2779 - protein, 18 aa, Artificial Sequence
  GFR-binding peptide
  MOD_RES (5)..(5): Xaa is C or S
EGLEXVPTEERPVQMRKI

SEQ ID NO: 2780 - protein, 11 aa, Artificial Sequence
  GFR-binding peptide
VHHRPVQVRKI

SEQ ID NO: 2781 - protein, 9 aa, Artificial Sequence
  GFR-binding peptide
ERSVKMAKV

SEQ ID NO: 2782 - protein, 18 aa, Artificial Sequence
  GFR-binding peptide
  MOD_RES (3)..(3): Xaa is C or S
VKXQPSRVHHRPVQVRKI

SEQ ID NO: 2783 - protein, 18 aa, Artificial Sequence
  GFR-binding peptide
  MOD_RES (5)..(5): Xaa is C or S
EGLEXVPTGQRPVQMRKI

SEQ ID NO: 2784 - protein, 20 aa, Artificial Sequence
  GFR-binding peptide
  MOD_RES (7)..(7): Xaa is C or S
NDEGLEXVPTGQRPVQMRKI

SEQ ID NO: 2785 - protein, 17 aa, Artificial Sequence
  GFR-binding peptide
  MOD_RES (2)..(2): Xaa is C or S
QXRPTQVQLRSVKVAKV

SEQ ID NO: 2786 - protein, 11 aa, Artificial Sequence
  GFR-binding peptide
VQLRSVKVAKV

SEQ ID NO: 2787 - protein, 12 aa, Artificial Sequence
  GFR-binding peptide
PTEERSVKMAKV

SEQ ID NO: 2788 - protein, 17 aa, Artificial Sequence
  GFR-binding peptide
  MOD_RES (2)..(2): Xaa is C or S
KXQPSRVHHRPVQVRKI

SEQ ID NO: 2789 - protein, 15 aa, Artificial Sequence
  GFR-binding peptide
  MOD_RES (2)..(2): Xaa is C or S
EXVPTGQRPVQMRKI

SEQ ID NO: 2790 - protein, 10 aa, Artificial Sequence
  GFR-binding peptide
GQRPVQMRKI

SEQ ID NO: 2791 - protein, 20 aa, Artificial Sequence
  GFR-binding peptide
  MOD_RES (7)..(7): Xaa is C or S
NDEGLEXVPTEERPVQMRKI

SEQ ID NO: 2792 - protein, 17 aa, Artificial Sequence
  GFR-binding peptide
  MOD_RES (4)..(4): Xaa is C or S
GLEXVPTEERSVKMAKV

SEQ ID NO: 2793 - protein, 17 aa, Artificial Sequence
  GFR-binding peptide
  MOD_RES (4)..(4): Xaa is C or S
GLEXVPTGQRPVQMRKI

SEQ ID NO: 2794 - protein, 9 aa, Artificial Sequence
  GFR-binding peptide
ERPVQMRKI

SEQ ID NO: 2795 - protein, 19 aa, Artificial Sequence
  GFR-binding peptide
  MOD_RES (4)..(4): Xaa is C or S
SVKXQPSRVHHSNITVQIM

SEQ ID NO: 2796 - protein, 9 aa, Artificial Sequence
  GFR-binding peptide
LSNITVQIM

SEQ ID NO: 2797 - protein, 16 aa, Artificial Sequence
  GFR-binding peptide
  MOD_RES (3)..(3): Xaa is C or S
LEXVPTEERSVKMAKV

SEQ ID NO: 2798 - protein, 18 aa, Artificial Sequence
  GFR-binding peptide
  MOD_RES (5)..(5): Xaa is C or S
EGLEXVPTEERSVKMAKV

SEQ ID NO: 2799 - protein, 16 aa, Artificial Sequence
  GFR-binding peptide
  MOD_RES (1)..(1): Xaa is C or S
XQPSRVHHRPVQVRKI

SEQ ID NO: 2800 - protein, 19 aa, Artificial Sequence
  GFR-binding peptide
  MOD_RES (4)..(4): Xaa is C or S
NVQXRPTQVQLSNITVQIM

SEQ ID NO: 2801 - protein, 9 aa, Artificial Sequence
  GFR-binding peptide
HRPVQVRKI

SEQ ID NO: 2802 - protein, 16 aa, Artificial Sequence
  GFR-binding peptide
  MOD_RES (1)..(1): Xaa is C or S
XQPSRVHHSNITVQIM

SEQ ID NO: 2803 - protein, 9 aa, Artificial Sequence
  GFR-binding peptide
HSNITVQIM

SEQ ID NO: 2804 - protein, 15 aa, Artificial Sequence
  GFR-binding peptide
  MOD_RES (2)..(2): Xaa is C or S
EXVPTEERPVQMRKI

SEQ ID NO: 2805 - protein, 10 aa, Artificial Sequence
  GFR-binding peptide
EERPVQMRKI

SEQ ID NO: 2806 - protein, 12 aa, Artificial Sequence
  GFR-binding peptide
PTGQRSVKMAKV

SEQ ID NO: 2807 - protein, 12 aa, Artificial Sequence
  GFR-binding peptide
QVQLSNITVQIM

SEQ ID NO: 2808 - protein, 18 aa, Artificial Sequence
  GFR-binding peptide
  MOD_RES (4)..(5): Xaa is C or S
PKAXXVPTELSPISMLYK

SEQ ID NO: 2809 - protein, 10 aa, Artificial Sequence
  GFR-binding peptide
ELSPISMLYI

SEQ ID NO: 2810 - protein, 18 aa, Artificial Sequence
  GFR-binding peptide
  MOD_RES (4)..(5): Xaa is C or S
ASPXXVSQDLSPISILYI

SEQ ID NO: 2811 - protein, 10 aa, Artificial Sequence
  GFR-binding peptide
ELSPISMLYK

SEQ ID NO: 2812 - protein, 18 aa, Artificial Sequence
  GFR-binding peptide
  MOD_RES (4)..(5): Xaa is C or S
ASPXXVSQDLSPISILYK

SEQ ID NO: 2813 - protein, 13 aa, Artificial Sequence
  GFR-binding peptide
VPQDLEPISILYL

SEQ ID NO: 2814 - protein, 14 aa, Artificial Sequence
  GFR-binding peptide
  MOD_RES (1)..(1): Xaa is C or S
XVPTKLNAISILYF

SEQ ID NO: 2815 - protein, 13 aa, Artificial Sequence
  GFR-binding peptide
VPTELEPISMLYL

SEQ ID NO: 2816 - protein, 15 aa, Artificial Sequence
  GFR-binding peptide
  MOD_RES (1)..(2): Xaa is C or S
XXAPTKLEPISVLYL

SEQ ID NO: 2817 - protein, 19 aa, Artificial Sequence
  GFR-binding peptide
  MOD_RES (5)..(6): Xaa is C or S
APASXXVPARLSPISILYK

SEQ ID NO: 2818 - protein, 14 aa, Artificial Sequence
  GFR-binding peptide
  MOD_RES (1)..(1): Xaa is C or S
XVSQDLEPISILYL

SEQ ID NO: 2819 - protein, 11 aa, Artificial Sequence
  GFR-binding peptide
QDLNAISILYF

SEQ ID NO: 2820 - protein, 19 aa, Artificial Sequence
  GFR-binding peptide
  MOD_RES (5)..(6): Xaa is C or S
VPKPXXAPTKLEPISVLYL

SEQ ID NO: 2821 - protein, 16 aa, Artificial Sequence
  GFR-binding peptide
  MOD_RES (3)..(3): Xaa is C or S
PTXAPTKLEPISVLYL

SEQ ID NO: 2822 - protein, 10 aa, Artificial Sequence
  GFR-binding peptide
DLEPISILYL

SEQ ID NO: 2823 - protein, 17 aa, Artificial Sequence
  GFR-binding peptide
  MOD_RES (3)..(4): Xaa is C or S
ASXXVPARLEPISILYL

SEQ ID NO: 2824 - protein, 12 aa, Artificial Sequence
  GFR-binding peptide
PQALSPISILYI

SEQ ID NO: 2825 - protein, 12 aa, Artificial Sequence
  GFR-binding peptide
PQALSPISILYK

SEQ ID NO: 2826 - protein, 12 aa, Artificial Sequence
  GFR-binding peptide
PARLNAISILYF

SEQ ID NO: 2827 - protein, 14 aa, Artificial Sequence
  GFR-binding peptide
  MOD_RES (1)..(1): Xaa is C or S
XVPTKLSPISILYI

SEQ ID NO: 2828 - protein, 18 aa, Artificial Sequence
  GFR-binding peptide
  MOD_RES (4)..(5): Xaa is C or S
PKAXXVPTELSPISMLYI

SEQ ID NO: 2829 - protein, 14 aa, Artificial Sequence
  GFR-binding peptide
  MOD_RES (1)..(1): Xaa is C or S
XVPTKLSPISILYK

SEQ ID NO: 2830 - protein, 19 aa, Artificial Sequence
  GFR-binding peptide
  MOD_RES (5)..(6): Xaa is C or S
VGKAXXVPTKLEPISVLYL

SEQ ID NO: 2831 - protein, 10 aa, Artificial Sequence
  GFR-binding peptide
ELNAISMLYF

SEQ ID NO: 2832 - protein, 16 aa, Artificial Sequence
  GFR-binding peptide
  MOD_RES (2)..(3): Xaa is C or S
PXXVPQDLEPISILYL

SEQ ID NO: 2833 - protein, 18 aa, Artificial Sequence
  GFR-binding peptide
  MOD_RES (4)..(5): Xaa is C or S
PKAXXAPTKLNAISVLYF

SEQ ID NO: 2834 - protein, 17 aa, Artificial Sequence
  GFR-binding peptide
  MOD_RES (3)..(4): Xaa is C or S
SPXXVSQDLEPISILYL

SEQ ID NO: 2835 - protein, 16 aa, Artificial Sequence
  GFR-binding peptide
  MOD_RES (2)..(3): Xaa is C or S
SXXVPARLNAISILYF

SEQ ID NO: 2836 - protein, 9 aa, Artificial Sequence
  GFR-binding peptide
LEPISVLYL

SEQ ID NO: 2837 - protein, 19 aa, Artificial Sequence
  GFR-binding peptide
  MOD_RES (5)..(6): Xaa is C or S
APASXXVPARLNAISILYF

SEQ ID NO: 2838 - protein, 12 aa, Artificial Sequence
  GFR-binding peptide
PTQLSPISVLYK

SEQ ID NO: 2839 - protein, 12 aa, Artificial Sequence
  GFR-binding peptide
PTQLSPISVLYI

SEQ ID NO: 2840 - protein, 17 aa, Artificial Sequence
  GFR-binding peptide
  MOD_RES (4)..(4): Xaa is C or S
KPTXAPTKLEPISVLYL

SEQ ID NO: 2841 - protein, 10 aa, Artificial Sequence
  GFR-binding peptide
KLSPISVLYI

SEQ ID NO: 2842 - protein, 11 aa, Artificial Sequence
  GFR-binding peptide
QALEPISILYL

SEQ ID NO: 2843 - protein, 16 aa, Artificial Sequence
  GFR-binding peptide
  MOD_RES (2)..(3): Xaa is C or S
SXXVPARLSPISILYK

SEQ ID NO: 2844 - protein, 17 aa, Artificial Sequence
  GFR-binding peptide
  MOD_RES (3)..(4): Xaa is C or S
KAXXAPTKLEPISVLYL

SEQ ID NO: 2845 - protein, 10 aa, Artificial Sequence
  GFR-binding peptide
RLEPISILYL

SEQ ID NO: 2846 - protein, 13 aa, Artificial Sequence
  GFR-binding peptide
VPARLNAISILYF

SEQ ID NO: 2847 - protein, 20 aa, Artificial Sequence
  GFR-binding peptide
  MOD_RES (6)..(7): Xaa is C or S
SIPKAXXVPTELEPISMLYL

SEQ ID NO: 2848 - protein, 20 aa, Artificial Sequence
  GFR-binding peptide
  MOD_RES (7)..(7): Xaa is C or S
HVTKPTXAPTKLEPISVLYL

SEQ ID NO: 2849 - protein, 15 aa, Artificial Sequence
  GFR-binding peptide
  MOD_RES (1)..(2): Xaa is C or S
XXVPARLSPISILYK

SEQ ID NO: 2850 - protein, 15 aa, Artificial Sequence
  GFR-binding peptide
  MOD_RES (1)..(2): Xaa is C or S
XXVPTELEPISMLYL

SEQ ID NO: 2851 - protein, 15 aa, Artificial Sequence
  GFR-binding peptide
  MOD_RES (2)..(2): Xaa is C or S
TXAPTKLEPISVLYL

SEQ ID NO: 2852 - protein, 15 aa, Artificial Sequence
  GFR-binding peptide
  MOD_RES (1)..(2): Xaa is C or S
XXVPQDLEPISILYL

SEQ ID NO: 2853 - protein, 17 aa, Artificial Sequence
  GFR-binding peptide
  MOD_RES (3)..(4): Xaa is C or S
SPXXVPQDLNAISILYF

SEQ ID NO: 2854 - protein, 14 aa, Artificial Sequence
  GFR-binding peptide
  MOD_RES (1)..(1): Xaa is C or S
XAPTQLEPISVLYL

SEQ ID NO: 2855 - protein, 11 aa, Artificial Sequence
  GFR-binding peptide
QDLSPISILYI

SEQ ID NO: 2856 - protein, 11 aa, Artificial Sequence
  GFR-binding peptide
QDLSPISILYK

SEQ ID NO: 2857 - protein, 19 aa, Artificial Sequence
  GFR-binding peptide
  MOD_RES (5)..(6): Xaa is C or S
SAAPXXVPQALEPISILYL

SEQ ID NO: 2858 - protein, 18 aa, Artificial Sequence
  GFR-binding peptide
  MOD_RES (4)..(5): Xaa is C or S
PASXXVPARLNAISILYF

SEQ ID NO: 2859 - protein, 11 aa, Artificial Sequence
  GFR-binding peptide
TQLEPISVLYL

SEQ ID NO: 2860 - protein, 18 aa, Artificial Sequence
  GFR-binding peptide
  MOD_RES (4)..(5): Xaa is C or S
PKAXXVPTELNAISMLYF

SEQ ID NO: 2861 - protein, 13 aa, Artificial Sequence
  GFR-binding peptide
VPTKLEPISVLYL

SEQ ID NO: 2862 - protein, 11 aa, Artificial Sequence
  GFR-binding peptide
TELSPISMLYK

SEQ ID NO: 2863 - protein, 11 aa, Artificial Sequence
  GFR-binding peptide
TELSPISMLYI

SEQ ID NO: 2864 - protein, 13 aa, Artificial Sequence
  GFR-binding peptide
VPARLSPISILYK

SEQ ID NO: 2865 - protein, 11 aa, Artificial Sequence
  GFR-binding peptide
TKLSPISVLYI

SEQ ID NO: 2866 - protein, 16 aa, Artificial Sequence
  GFR-binding peptide
  MOD_RES (2)..(3): Xaa is C or S
PXXAPTKLEPISVLYL

SEQ ID NO: 2867 - protein, 17 aa, Artificial Sequence
  GFR-binding peptide
  MOD_RES (3)..(4): Xaa is C or S
KAXXVPTELSPISMLYI

SEQ ID NO: 2868 - protein, 15 aa, Artificial Sequence
  GFR-binding peptide
  MOD_RES (1)..(2): Xaa is C or S
XXVPTKLEPISVLYL

SEQ ID NO: 2869 - protein, 17 aa, Artificial Sequence
  GFR-binding peptide
  MOD_RES (3)..(4): Xaa is C or S
APXXVPQALSPISILYK

SEQ ID NO: 2870 - protein, 17 aa, Artificial Sequence
  GFR-binding peptide
  MOD_RES (3)..(4): Xaa is C or S
APXXVPQALSPISILYI

SEQ ID NO: 2871 - protein, 18 aa, Artificial Sequence
  GFR-binding peptide
  MOD_RES (4)..(5): Xaa is C or S
GKAXXVPTKLNAISVLYF

SEQ ID NO: 2872 - protein, 15 aa, Artificial Sequence
  GFR-binding peptide
  MOD_RES (1)..(2): Xaa is C or S
XXVPARLNAISILYF

SEQ ID NO: 2873 - protein, 17 aa, Artificial Sequence
  GFR-binding peptide
  MOD_RES (3)..(4): Xaa is C or S
KAXXVPTELNAISMLYF

SEQ ID NO: 2874 - protein, 9 aa, Artificial Sequence
  GFR-binding peptide
LEPISMLYL

SEQ ID NO: 2875 - protein, 17 aa, Artificial Sequence
  GFR-binding peptide
  MOD_RES (3)..(4): Xaa is C or S
APXXVPQALNAISILYF

SEQ ID NO: 2876 - protein, 18 aa, Artificial Sequence
  GFR-binding peptide
  MOD_RES (4)..(5): Xaa is C or S
GKAXXVPTKLSPISVLYI

SEQ ID NO: 2877 - protein, 19 aa, Artificial Sequence
  GFR-binding peptide
  MOD_RES (5)..(6): Xaa is C or S
SASPXXVPQDLEPISILYL

SEQ ID NO: 2878 - protein, 20 aa, Artificial Sequence
  GFR-binding peptide
  MOD_RES (6)..(7): Xaa is C or S
KVGKAXXVPTKLEPISVLYL

SEQ ID NO: 2879 - protein, 11 aa, Artificial Sequence
  GFR-binding peptide
TELNAISMLYF

SEQ ID NO: 2880 - protein, 17 aa, Artificial Sequence
  GFR-binding peptide
  MOD_RES (3)..(4): Xaa is C or S
KAXXVPTELSPISMLYK

SEQ ID NO: 2881 - protein, 20 aa, Artificial Sequence
  GFR-binding peptide
  MOD_RES (6)..(7): Xaa is C or S
TVPKPXXAPTQLSPISVLYI

SEQ ID NO: 2882 - protein, 17 aa, Artificial Sequence
  GFR-binding peptide
  MOD_RES (3)..(4): Xaa is C or S
APXXVPQALEPISILYL

SEQ ID NO: 2883 - protein, 18 aa, Artificial Sequence
  GFR-binding peptide
  MOD_RES (4)..(5): Xaa is C or S
ASPXXVPQDLSPISILYI

SEQ ID NO: 2884 - protein, 18 aa, Artificial Sequence
  GFR-binding peptide
  MOD_RES (4)..(5): Xaa is C or S
ASPXXVPQDLSPISILYK

SEQ ID NO: 2885 - protein, 14 aa, Artificial Sequence
  GFR-binding peptide
  MOD_RES (1)..(1): Xaa is C or S
XVPTKLSPISVLYI

SEQ ID NO: 2886 - protein, 17 aa, Artificial Sequence
  GFR-binding peptide
  MOD_RES (3)..(4): Xaa is C or S
KAXXAPTKLNAISVLYF

SEQ ID NO: 2887 - protein, 17 aa, Artificial Sequence
  GFR-binding peptide
  MOD_RES (3)..(4): Xaa is C or S
SPXXVPQDLSPISILYK

SEQ ID NO: 2888 - protein, 17 aa, Artificial Sequence
  GFR-binding peptide
  MOD_RES (3)..(4): Xaa is C or S
SPXXVPQDLSPISILYI

SEQ ID NO: 2889 - protein, 16 aa, Artificial Sequence
  GFR-binding peptide
  MOD_RES (2)..(3): Xaa is C or S
PXXVPQALSPISILYI

SEQ ID NO: 2890 - protein, 20 aa, Artificial Sequence
  GFR-binding peptide
  MOD_RES (6)..(7): Xaa is C or S
AVPKAXXAPTKLSPISVLYI

SEQ ID NO: 2891 - protein, 16 aa, Artificial Sequence
  GFR-binding peptide
  MOD_RES (2)..(3): Xaa is C or S
PXXVPQALSPISILYK

SEQ ID NO: 2892 - protein, 16 aa, Artificial Sequence
  GFR-binding peptide
  MOD_RES (2)..(3): Xaa is C or S
PXXAPTQLEPISVLYL

SEQ ID NO: 2893 - protein, 20 aa, Artificial Sequence
  GFR-binding peptide
  MOD_RES (6)..(7): Xaa is C or S
TVPKPXXAPTQLEPISVLYL

SEQ ID NO: 2894 - protein, 19 aa, Artificial Sequence
  GFR-binding peptide
  MOD_RES (5)..(6): Xaa is C or S
VPKPXXAPTQLEPISVLYL

SEQ ID NO: 2895 - protein, 17 aa, Artificial Sequence
  GFR-binding peptide
  MOD_RES (3)..(4): Xaa is C or S
KAXXVPTKLNAISVLYF

SEQ ID NO: 2896 - protein, 19 aa, Artificial Sequence
  GFR-binding peptide
  MOD_RES (5)..(6): Xaa is C or S
SASPXXVSQDLSPISILYI

SEQ ID NO: 2897 - protein, 19 aa, Artificial Sequence
  GFR-binding peptide
  MOD_RES (5)..(6): Xaa is C or S
SASPXXVSQDLSPISILYK

SEQ ID NO: 2898 - protein, 17 aa, Artificial Sequence
  GFR-binding peptide
  MOD_RES (3)..(4): Xaa is C or S
KPXXAPTKLEPISVLYL

SEQ ID NO: 2899 - protein, 15 aa, Artificial Sequence
  GFR-binding peptide
  MOD_RES (1)..(2): Xaa is C or S
XXVPQDLNAISILYF

SEQ ID NO: 2900 - protein, 14 aa, Artificial Sequence
  GFR-binding peptide
  MOD_RES (1)..(1): Xaa is C or S
XVPTELSPISMLYK

SEQ ID NO: 2901 - protein, 20 aa, Artificial Sequence
  GFR-binding peptide
  MOD_RES (6)..(7): Xaa is C or S
KIPKAXXVPTELNAISMLYF

SEQ ID NO: 2902 - protein, 11 aa, Artificial Sequence
  GFR-binding peptide
TKLEPISVLYL

SEQ ID NO: 2903 - protein, 18 aa, Artificial Sequence
  GFR-binding peptide
  MOD_RES (4)..(5): Xaa is C or S
ASPXXVPQDLEPISILYL

SEQ ID NO: 2904 - protein, 10 aa, Artificial Sequence
  GFR-binding peptide
RLNAISILYF

SEQ ID NO: 2905 - protein, 12 aa, Artificial Sequence
  GFR-binding peptide
SQDLNAISILYF

SEQ ID NO: 2906 - protein, 10 aa, Artificial Sequence
  GFR-binding peptide
ALNAISILYF

SEQ ID NO: 2907 - protein, 13 aa, Artificial Sequence
  GFR-binding peptide
VPTKLNAISILYF

SEQ ID NO: 2908 - protein, 20 aa, Artificial Sequence
  GFR-binding peptide
  MOD_RES (6)..(7): Xaa is C or S
KVGKAXXVPTKLSPISVLYI

SEQ ID NO: 2909 - protein, 15 aa, Artificial Sequence
  GFR-binding peptide
  MOD_RES (1)..(2): Xaa is C or S
XXVPTKLNAISILYF

SEQ ID NO: 2910 - protein, 15 aa, Artificial Sequence
  GFR-binding peptide
  MOD_RES (1)..(2): Xaa is C or S
XXVPQALNAISILYF

SEQ ID NO: 2911 - protein, 13 aa, Artificial Sequence
  GFR-binding peptide
VPQALNAISILYF

SEQ ID NO: 2912 - protein, 17 aa, Artificial Sequence
  GFR-binding peptide
  MOD_RES (3)..(4): Xaa is C or S
KAXXVPTELEPISMLYL

SEQ ID NO: 2913 - protein, 12 aa, Artificial Sequence
  GFR-binding peptide
PARLSPISILYK

SEQ ID NO: 2914 - protein, 15 aa, Artificial Sequence
  GFR-binding peptide
  MOD_RES (2)..(2): Xaa is C or S
TXAPTKLSPISVLYI

SEQ ID NO: 2915 - protein, 12 aa, Artificial Sequence
  GFR-binding peptide
PTELSPISMLYK

SEQ ID NO: 2916 - protein, 12 aa, Artificial Sequence
  GFR-binding peptide
PTELSPISMLYI

SEQ ID NO: 2917 - protein, 9 aa, Artificial Sequence
  GFR-binding peptide
LSPISMLYK

SEQ ID NO: 2918 - protein, 15 aa, Artificial Sequence
  GFR-binding peptide
  MOD_RES (2)..(2): Xaa is C or S
TXAPTKLSPISVLYK

SEQ ID NO: 2919 - protein, 9 aa, Artificial Sequence
  GFR-binding peptide
LSPISMLYI

SEQ ID NO: 2920 - protein, 14 aa, Artificial Sequence
  GFR-binding peptide
  MOD_RES (1)..(1): Xaa is C or S
XVSQDLNAISILYF

SEQ ID NO: 2921 - protein, 13 aa, Artificial Sequence
  GFR-binding peptide
APTKLEPISVLYL

SEQ ID NO: 2922 - protein, 10 aa, Artificial Sequence
  GFR-binding peptide
KLSPISILYK

SEQ ID NO: 2923 - protein, 10 aa, Artificial Sequence
  GFR-binding peptide
KLSPISILYI

SEQ ID NO: 2924 - protein, 11 aa, Artificial Sequence
  GFR-binding peptide
ARLEPISILYL

SEQ ID NO: 2925 - protein, 15 aa, Artificial Sequence
  GFR-binding peptide
  MOD_RES (1)..(2): Xaa is C or S
XXVPTELSPISMLYK

SEQ ID NO: 2926 - protein, 14 aa, Artificial Sequence
  GFR-binding peptide
  MOD_RES (1)..(1): Xaa is C or S
XVPQDLNAISILYF

SEQ ID NO: 2927 - protein, 15 aa, Artificial Sequence
  GFR-binding peptide
  MOD_RES (1)..(2): Xaa is C or S
XXVPTELSPISMLYI

SEQ ID NO: 2928 - protein, 13 aa, Artificial Sequence
  GFR-binding peptide
VPQDLNAISILYF

SEQ ID NO: 2929 - protein, 20 aa, Artificial Sequence
  GFR-binding peptide
  MOD_RES (6)..(7): Xaa is C or S
ASASPXXVPQDLSPISILYK

SEQ ID NO: 2930 - protein, 17 aa, Artificial Sequence
  GFR-binding peptide
  MOD_RES (3)..(4): Xaa is C or S
KAXXVPTKLEPISVLYL

SEQ ID NO: 2931 - protein, 19 aa, Artificial Sequence
  GFR-binding peptide
  MOD_RES (5)..(6): Xaa is C or S
VGKAXXVPTKLNAISVLYF

SEQ ID NO: 2932 - protein, 14 aa, Artificial Sequence
  GFR-binding peptide
  MOD_RES (1)..(1): Xaa is C or S
XVPQALEPISILYL

SEQ ID NO: 2933 - protein, 14 aa, Artificial Sequence
  GFR-binding peptide
  MOD_RES (1)..(1): Xaa is C or S
XVPTELSPISMLYI

SEQ ID NO: 2934 - protein, 16 aa, Artificial Sequence
  GFR-binding peptide
  MOD_RES (2)..(3): Xaa is C or S
AXXVPTKLNAISVLYF

SEQ ID NO: 2935 - protein, 16 aa, Artificial Sequence
  GFR-binding peptide
  MOD_RES (2)..(3): Xaa is C or S
PXXVSQDLSPISILYI

SEQ ID NO: 2936 - protein, 16 aa, Artificial Sequence
  GFR-binding peptide
  MOD_RES (2)..(3): Xaa is C or S
PXXVSQDLSPISILYK

SEQ ID NO: 2937 - protein, 14 aa, Artificial Sequence
  GFR-binding peptide
  MOD_RES (1)..(1): Xaa is C or S
XAPTKLEPISVLYL

SEQ ID NO: 2938 - protein, 10 aa, Artificial Sequence
  GFR-binding peptide
DLNAISILYF

SEQ ID NO: 2939 - protein, 18 aa, Artificial Sequence
  GFR-binding peptide
  MOD_RES (5)..(5): Xaa is C or S
TKPTXAPTKLEPISVLYL

SEQ ID NO: 2940 - protein, 20 aa, Artificial Sequence
  GFR-binding peptide
  MOD_RES (6)..(7): Xaa is C or S
ASAAPXXVPQALNAISILYF

SEQ ID NO: 2941 - protein, 18 aa, Artificial Sequence
  GFR-binding peptide
  MOD_RES (4)..(5): Xaa is C or S
SKAXXVPTKLSPISILYK

SEQ ID NO: 2942 - protein, 18 aa, Artificial Sequence
  GFR-binding peptide
  MOD_RES (4)..(5): Xaa is C or S
SKAXXVPTKLSPISILYI

SEQ ID NO: 2943 - protein, 17 aa, Artificial Sequence
  GFR-binding peptide
  MOD_RES (3)..(4): Xaa is C or S
KPXXAPTQLEPISVLYL

SEQ ID NO: 2944 - protein, 18 aa, Artificial Sequence
  GFR-binding peptide
  MOD_RES (4)..(5): Xaa is C or S
ASPXXVSQDLNAISILYF

SEQ ID NO: 2945 - protein, 12 aa, Artificial Sequence
  GFR-binding peptide
PQDLEPISILYL

SEQ ID NO: 2946 - protein, 14 aa, Artificial Sequence
  GFR-binding peptide
  MOD_RES (1)..(1): Xaa is C or S
XVPARLSPISILYK

SEQ ID NO: 2947 - protein, 12 aa, Artificial Sequence
  GFR-binding peptide
PTKLSPISVLYI

SEQ ID NO: 2948 - protein, 20 aa, Artificial Sequence
  GFR-binding peptide
  MOD_RES (6)..(7): Xaa is C or S
KIPKAXXVPTELEPISMLYL

SEQ ID NO: 2949 - protein, 12 aa, Artificial Sequence
  GFR-binding peptide
PQALNAISILYF

SEQ ID NO: 2950 - protein, 16 aa, Artificial Sequence
  GFR-binding peptide
  MOD_RES (2)..(3): Xaa is C or S
AXXVPTKLEPISVLYL

SEQ ID NO: 2951 - protein, 16 aa, Artificial Sequence
  GFR-binding peptide
  MOD_RES (2)..(3): Xaa is C or S
AXXVPTELEPISMLYL

SEQ ID NO: 2952 - protein, 18 aa, Artificial Sequence
  GFR-binding peptide
  MOD_RES (4)..(5): Xaa is C or S
PKPXXAPTQLEPISVLYL

SEQ ID NO: 2953 - protein, 17 aa, Artificial Sequence
  GFR-binding peptide
  MOD_RES (3)..(4): Xaa is C or S
KAXXVPTKLNAISILYF

SEQ ID NO: 2954 - protein, 20 aa, Artificial Sequence
  GFR-binding peptide
  MOD_RES (6)..(7): Xaa is C or S
AAPASXXVPARLSPISILYK

SEQ ID NO: 2955 - protein, 13 aa, Artificial Sequence
  GFR-binding peptide
APTQLEPISVLYL

SEQ ID NO: 2956 - protein, 14 aa, Artificial Sequence
  GFR-binding peptide
  MOD_RES (1)..(1): Xaa is C or S
XVPQDLEPISILYL

SEQ ID NO: 2957 - protein, 16 aa, Artificial Sequence
  GFR-binding peptide
  MOD_RES (2)..(3): Xaa is C or S
SXXVPARLEPISILYL

SEQ ID NO: 2958 - protein, 19 aa, Artificial Sequence
  GFR-binding peptide
  MOD_RES (5)..(6): Xaa is C or S
VPKAXXAPTKLEPISVLYL

SEQ ID NO: 2959 - protein, 15 aa, Artificial Sequence
  GFR-binding peptide
  MOD_RES (1)..(2): Xaa is C or S
XXAPTQLEPISVLYL

SEQ ID NO: 2960 - protein, 11 aa, Artificial Sequence
  GFR-binding peptide
TKLNAISILYF

SEQ ID NO: 2961 - protein, 19 aa, Artificial Sequence
  GFR-binding peptide
  MOD_RES (6)..(6): Xaa is C or S
VTKPTXAPTKLEPISVLYL

SEQ ID NO: 2962 - protein, 9 aa, Artificial Sequence
  GFR-binding peptide
LNAISILYF

SEQ ID NO: 2963 - protein, 12 aa, Artificial Sequence
  GFR-binding peptide
PTKLSPISILYI

SEQ ID NO: 2964 - protein, 17 aa, Artificial Sequence
  GFR-binding peptide
  MOD_RES (3)..(4): Xaa is C or S
SPXXVSQDLSPISILYK

SEQ ID NO: 2965 - protein, 14 aa, Artificial Sequence
  GFR-binding peptide
  MOD_RES (1)..(1): Xaa is C or S
XVPQALNAISILYF

SEQ ID NO: 2966 - protein, 17 aa, Artificial Sequence
  GFR-binding peptide
  MOD_RES (3)..(4): Xaa is C or S
SPXXVSQDLSPISILYI

SEQ ID NO: 2967 - protein, 20 aa, Artificial Sequence
  GFR-binding peptide
  MOD_RES (6)..(7): Xaa is C or S
KASKAXXVPTKLSPISILYK

SEQ ID NO: 2968 - protein, 15 aa, Artificial Sequence
  GFR-binding peptide
  MOD_RES (1)..(2): Xaa is C or S
XXAPTKLSPISVLYK

SEQ ID NO: 2969 - protein, 13 aa, Artificial Sequence
  GFR-binding peptide
VPARLEPISILYL

SEQ ID NO: 2970 - protein, 15 aa, Artificial Sequence
  GFR-binding peptide
  MOD_RES (1)..(2): Xaa is C or S
XXAPTKLSPISVLYI

SEQ ID NO: 2971 - protein, 20 aa, Artificial Sequence
  GFR-binding peptide
  MOD_RES (6)..(7): Xaa is C or S
AAPASXXVPARLNAISILYF

SEQ ID NO: 2972 - protein, 19 aa, Artificial Sequence
  GFR-binding peptide
  MOD_RES (5)..(6): Xaa is C or S
APASXXVPARLEPISILYL

SEQ ID NO: 2973 - protein, 16 aa, Artificial Sequence
  GFR-binding peptide
  MOD_RES (2)..(3): Xaa is C or S
PXXAPTKLSPISVLYK

SEQ ID NO: 2974 - protein, 16 aa, Artificial Sequence
  GFR-binding peptide
  MOD_RES (2)..(3): Xaa is C or S
PXXAPTKLSPISVLYI

SEQ ID NO: 2975 - protein, 19 aa, Artificial Sequence
  GFR-binding peptide
  MOD_RES (5)..(6): Xaa is C or S
SAAPXXVPQALSPISILYI

SEQ ID NO: 2976 - protein, 19 aa, Artificial Sequence
  GFR-binding peptide
  MOD_RES (5)..(6): Xaa is C or S
SAAPXXVPQALSPISILYK

SEQ ID NO: 2977 - protein, 18 aa, Artificial Sequence
  GFR-binding peptide
  MOD_RES (4)..(5): Xaa is C or S
PKAXXVPTELEPISMLYL

SEQ ID NO: 2978 - protein, 18 aa, Artificial Sequence
  GFR-binding peptide
  MOD_RES (4)..(5): Xaa is C or S
ASPXXVSQDLEPISILYL

SEQ ID NO: 2979 - protein, 13 aa, Artificial Sequence
  GFR-binding peptide
VPQDLSPISILYI

SEQ ID NO: 2980 - protein, 19 aa, Artificial Sequence
  GFR-binding peptide
  MOD_RES (5)..(6): Xaa is C or S
IPKAXXVPTELSPISMLYI

SEQ ID NO: 2981 - protein, 19 aa, Artificial Sequence
  GFR-binding peptide
  MOD_RES (5)..(6): Xaa is C or S
SAAPXXVPQALNAISILYF

SEQ ID NO: 2982 - protein, 10 aa, Artificial Sequence
  GFR-binding peptide
ELEPISMLYL

SEQ ID NO: 2983 - protein, 13 aa, Artificial Sequence
  GFR-binding peptide
VPQDLSPISILYK

SEQ ID NO: 2984 - protein, 19 aa, Artificial Sequence
  GFR-binding peptide
  MOD_RES (5)..(6): Xaa is C or S
IPKAXXVPTELSPISMLYK

SEQ ID NO: 2985 - protein, 17 aa, Artificial Sequence
  GFR-binding peptide
  MOD_RES (3)..(4): Xaa is C or S
ASXXVPARLSPISILYK

SEQ ID NO: 2986 - protein, 14 aa, Artificial Sequence
  GFR-binding peptide
  MOD_RES (1)..(1): Xaa is C or S
XAPTQLSPISVLYI

SEQ ID NO: 2987 - protein, 14 aa, Artificial Sequence
  GFR-binding peptide
  MOD_RES (1)..(1): Xaa is C or S
XAPTQLSPISVLYK

SEQ ID NO: 2988 - protein, 12 aa, Artificial Sequence
  GFR-binding peptide
PTELNAISMLYF

SEQ ID NO: 2989 - protein, 12 aa, Artificial Sequence
  GFR-binding peptide
PQALEPISILYL

SEQ ID NO: 2990 - protein, 12 aa, Artificial Sequence
  GFR-binding peptide
PTKLSPISILYK

SEQ ID NO: 2991 - protein, 16 aa, Artificial Sequence
  GFR-binding peptide
  MOD_RES (2)..(3): Xaa is C or S
AXXVPTELSPISMLYI

SEQ ID NO: 2992 - protein, 15 aa, Artificial Sequence
  GFR-binding peptide
  MOD_RES (1)..(2): Xaa is C or S
XXVPTKLSPISVLYI

SEQ ID NO: 2993 - protein, 16 aa, Artificial Sequence
  GFR-binding peptide
  MOD_RES (2)..(3): Xaa is C or S
AXXVPTELSPISMLYK

SEQ ID NO: 2994 - protein, 13 aa, Artificial Sequence
  GFR-binding peptide
VPTELSPISMLYK

SEQ ID NO: 2995 - protein, 11 aa, Artificial Sequence
  GFR-binding peptide
ARLSPISILYK

SEQ ID NO: 2996 - protein, 13 aa, Artificial Sequence
  GFR-binding peptide
VPTKLNAISVLYF

SEQ ID NO: 2997 - protein, 14 aa, Artificial Sequence
  GFR-binding peptide
  MOD_RES (1)..(1): Xaa is C or S
XVSQDLSPISILYK

SEQ ID NO: 2998 - protein, 19 aa, Artificial Sequence
  GFR-binding peptide
  MOD_RES (5)..(6): Xaa is C or S
VPKAXXAPTKLNAISVLYF

SEQ ID NO: 2999 - protein, 14 aa, Artificial Sequence
  GFR-binding peptide
  MOD_RES (1)..(1): Xaa is C or S
XVSQDLSPISILYI

SEQ ID NO: 3000 - protein, 13 aa, Artificial Sequence
  GFR-binding peptide
VPTELSPISMLYI

SEQ ID NO: 3001 - protein, 12 aa, Artificial Sequence
  GFR-binding peptide
PQDLNAISILYF

SEQ ID NO: 3002 - protein, 19 aa, Artificial Sequence
  GFR-binding peptide
  MOD_RES (5)..(6): Xaa is C or S
IPKAXXVPTELNAISMLYF

SEQ ID NO: 3003 - protein, 18 aa, Artificial Sequence
  GFR-binding peptide
  MOD_RES (4)..(5): Xaa is C or S
PKPXXAPTKLEPISVLYL

SEQ ID NO: 3004 - protein, 20 aa, Artificial Sequence
  GFR-binding peptide
  MOD_RES (6)..(7): Xaa is C or S
SIPKAXXVPTELSPISMLYI

SEQ ID NO: 3005 - protein, 20 aa, Artificial Sequence
  GFR-binding peptide
  MOD_RES (6)..(7): Xaa is C or S
SIPKAXXVPTELSPISMLYK

SEQ ID NO: 3006 - protein, 19 aa, Artificial Sequence
  GFR-binding peptide
  MOD_RES (5)..(6): Xaa is C or S
SASPXXVPQDLNAISILYF

SEQ ID NO: 3007 - protein, 13 aa, Artificial Sequence
  GFR-binding peptide
VPTKLSPISVLYI

SEQ ID NO: 3008 - protein, 20 aa, Artificial Sequence
  GFR-binding peptide
  MOD_RES (6)..(7): Xaa is C or S
SIPKAXXVPTELNAISMLYF

SEQ ID NO: 3009 - protein, 19 aa, Artificial Sequence
  GFR-binding peptide
  MOD_RES (5)..(6): Xaa is C or S
VPKAXXAPTKLSPISVLYK

SEQ ID NO: 3010 - protein, 19 aa, Artificial Sequence
  GFR-binding peptide
  MOD_RES (5)..(6): Xaa is C or S
VPKAXXAPTKLSPISVLYI

SEQ ID NO: 3011 - protein, 18 aa, Artificial Sequence
  GFR-binding peptide
  MOD_RES (4)..(5): Xaa is C or S
GKAXXVPTKLEPISVLYL

SEQ ID NO: 3012 - protein, 16 aa, Artificial Sequence
  GFR-binding peptide
  MOD_RES (2)..(3): Xaa is C or S
AXXVPTELNAISMLYF

SEQ ID NO: 3013 - protein, 11 aa, Artificial Sequence
  GFR-binding peptide
ARLNAISILYF

SEQ ID NO: 3014 - protein, 19 aa, Artificial Sequence
  GFR-binding peptide
  MOD_RES (5)..(6): Xaa is C or S
SASPXXVPQDLSPISILYI

SEQ ID NO: 3015 - protein, 16 aa, Artificial Sequence
  GFR-binding peptide
  MOD_RES (2)..(3): Xaa is C or S
AXXVPTKLSPISILYI

SEQ ID NO: 3016 - protein, 19 aa, Artificial Sequence
  GFR-binding peptide
  MOD_RES (5)..(6): Xaa is C or S
SASPXXVPQDLSPISILYK

SEQ ID NO: 3017 - protein, 20 aa, Artificial Sequence
  GFR-binding peptide
  MOD_RES (6)..(7): Xaa is C or S
KASKAXXVPTKLNAISILYF

SEQ ID NO: 3018 - protein, 9 aa, Artificial Sequence
  GFR-binding peptide
LNAISMLYF

SEQ ID NO: 3019 - protein, 16 aa, Artificial Sequence
  GFR-binding peptide
  MOD_RES (2)..(3): Xaa is C or S
AXXVPTKLSPISILYK

SEQ ID NO: 3020 - protein, 20 aa, Artificial Sequence
  GFR-binding peptide
  MOD_RES (6)..(7): Xaa is C or S
YVPKPXXAPTKLSPISVLYI

SEQ ID NO: 3021 - protein, 13 aa, Artificial Sequence
  GFR-binding peptide
VPQALEPISILYL

SEQ ID NO: 3022 - protein, 16 aa, Artificial Sequence
  GFR-binding peptide
  MOD_RES (2)..(3): Xaa is C or S
AXXAPTKLNAISVLYF

SEQ ID NO: 3023 - protein, 16 aa, Artificial Sequence
  GFR-binding peptide
  MOD_RES (2)..(3): Xaa is C or S
AXXVPTKLNAISILYF

SEQ ID NO: 3024 - protein, 11 aa, Artificial Sequence
  GFR-binding peptide
TELEPISMLYL

SEQ ID NO: 3025 - protein, 15 aa, Artificial Sequence
  GFR-binding peptide
  MOD_RES (1)..(2): Xaa is C or S
XXVPARLEPISILYL

SEQ ID NO: 3026 - protein, 15 aa, Artificial Sequence
  GFR-binding peptide
  MOD_RES (1)..(2): Xaa is C or S
XXVPTKLNAISVLYF

SEQ ID NO: 3027 - protein, 18 aa, Artificial Sequence
  GFR-binding peptide
  MOD_RES (4)..(5): Xaa is C or S
PKAXXAPTKLEPISVLYL

SEQ ID NO: 3028 - protein, 12 aa, Artificial Sequence
  GFR-binding peptide
PARLEPISILYL

SEQ ID NO: 3029 - protein, 11 aa, Artificial Sequence
  GFR-binding peptide
TQLSPISVLYI

SEQ ID NO: 3030 - protein, 11 aa, Artificial Sequence
  GFR-binding peptide
TQLSPISVLYK

SEQ ID NO: 3031 - protein, 19 aa, Artificial Sequence
  GFR-binding peptide
  MOD_RES (5)..(6): Xaa is C or S
ASKAXXVPTKLSPISILYK

SEQ ID NO: 3032 - protein, 19 aa, Artificial Sequence
  GFR-binding peptide
  MOD_RES (5)..(6): Xaa is C or S
ASKAXXVPTKLSPISILYI

SEQ ID NO: 3033 - protein, 17 aa, Artificial Sequence
  GFR-binding peptide
  MOD_RES (3)..(4): Xaa is C or S
ASXXVPARLNAISILYF

SEQ ID NO: 3034 - protein, 19 aa, Artificial Sequence
  GFR-binding peptide
  MOD_RES (5)..(6): Xaa is C or S
VPKPXXAPTQLSPISVLYK

SEQ ID NO: 3035 - protein, 19 aa, Artificial Sequence
  GFR-binding peptide
  MOD_RES (5)..(6): Xaa is C or S
VPKPXXAPTQLSPISVLYI

SEQ ID NO: 3036 - protein, 11 aa, Artificial Sequence
  GFR-binding peptide
QDLEPISILYL

SEQ ID NO: 3037 - protein, 19 aa, Artificial Sequence
  GFR-binding peptide
  MOD_RES (5)..(6): Xaa is C or S
ASKAXXVPTKLNAISILYF

SEQ ID NO: 3038 - protein, 18 aa, Artificial Sequence
  GFR-binding peptide
  MOD_RES (4)..(5): Xaa is C or S
AAPXXVPQALNAISILYF

SEQ ID NO: 3039 - protein, 16 aa, Artificial Sequence
  GFR-binding peptide
  MOD_RES (2)..(3): Xaa is C or S
AXXAPTKLSPISVLYK

SEQ ID NO: 3040 - protein, 12 aa, Artificial Sequence
  GFR-binding peptide
SQDLEPISILYL

SEQ ID NO: 3041 - protein, 16 aa, Artificial Sequence
  GFR-binding peptide
  MOD_RES (3)..(3): Xaa is C or S
PTXAPTKLSPISVLYK

SEQ ID NO: 3042 - protein, 16 aa, Artificial Sequence
  GFR-binding peptide
  MOD_RES (2)..(3): Xaa is C or S
AXXAPTKLSPISVLYI

SEQ ID NO: 3043 - protein, 15 aa, Artificial Sequence
  GFR-binding peptide
  MOD_RES (1)..(2): Xaa is C or S
XXVSQDLNAISILYF

SEQ ID NO: 3044 - protein, 9 aa, Artificial Sequence
  GFR-binding peptide
LSPISVLYI

SEQ ID NO: 3045 - protein, 19 aa, Artificial Sequence
  GFR-binding peptide
  MOD_RES (5)..(6): Xaa is C or S
VPKPXXAPTKLSPISVLYK

SEQ ID NO: 3046 - protein, 12 aa, Artificial Sequence
  GFR-binding peptide
PTKLNAISILYF

SEQ ID NO: 3047 - protein, 19 aa, Artificial Sequence
  GFR-binding peptide
  MOD_RES (5)..(6): Xaa is C or S
VPKPXXAPTKLSPISVLYI

SEQ ID NO: 3048 - protein, 17 aa, Artificial Sequence
  GFR-binding peptide
  MOD_RES (3)..(4): Xaa is C or S
KAXXVPTKLSPISVLYI

SEQ ID NO: 3049 - protein, 16 aa, Artificial Sequence
  GFR-binding peptide
  MOD_RES (3)..(3): Xaa is C or S
PTXAPTKLSPISVLYI

SEQ ID NO: 3050 - protein, 10 aa, Artificial Sequence
  GFR-binding peptide
ALEPISILYL

SEQ ID NO: 3051 - protein, 16 aa, Artificial Sequence
  GFR-binding peptide
  MOD_RES (2)..(3): Xaa is C or S
PXXVPQDLSPISILYI

SEQ ID NO: 3052 - protein, 11 aa, Artificial Sequence
  GFR-binding peptide
QALNAISILYF

SEQ ID NO: 3053 - protein, 20 aa, Artificial Sequence
  GFR-binding peptide
  MOD_RES (6)..(7): Xaa is C or S
ASASPXXVSQDLNAISILYF

SEQ ID NO: 3054 - protein, 10 aa, Artificial Sequence
  GFR-binding peptide
QLSPISVLYI

SEQ ID NO: 3055 - protein, 10 aa, Artificial Sequence
  GFR-binding peptide
QLSPISVLYK

SEQ ID NO: 3056 - protein, 13 aa, Artificial Sequence
  GFR-binding peptide
VSQDLNAISILYF

SEQ ID NO: 3057 - protein, 16 aa, Artificial Sequence
  GFR-binding peptide
  MOD_RES (2)..(3): Xaa is C or S
PXXVPQDLSPISILYK

SEQ ID NO: 3058 - protein, 15 aa, Artificial Sequence
  GFR-binding peptide
  MOD_RES (1)..(2): Xaa is C or S
XXVPQALEPISILYL

SEQ ID NO: 3059 - protein, 13 aa, Artificial Sequence
  GFR-binding peptide
VSQDLSPISILYI

SEQ ID NO: 3060 - protein, 15 aa, Artificial Sequence
  GFR-binding peptide
  MOD_RES (1)..(2): Xaa is C or S
XXVSQDLSPISILYK

SEQ ID NO: 3061 - protein, 15 aa, Artificial Sequence
  GFR-binding peptide
  MOD_RES (1)..(2): Xaa is C or S
XXVSQDLSPISILYI

SEQ ID NO: 3062 - protein, 18 aa, Artificial Sequence
  GFR-binding peptide
  MOD_RES (4)..(5): Xaa is C or S
ASPXXVPQDLNAISILYF

SEQ ID NO: 3063 - protein, 18 aa, Artificial Sequence
  GFR-binding peptide
  MOD_RES (4)..(5): Xaa is C or S
PASXXVPARLSPISILYK

SEQ ID NO: 3064 - protein, 11 aa, Artificial Sequence
  GFR-binding peptide
QALSPISILYK

SEQ ID NO: 3065 - protein, 20 aa, Artificial Sequence
  GFR-binding peptide
  MOD_RES (6)..(7): Xaa is C or S
ASASPXXVSQDLSPISILYK

SEQ ID NO: 3066 - protein, 17 aa, Artificial Sequence
  GFR-binding peptide
  MOD_RES (4)..(4): Xaa is C or S
KPTXAPTKLSPISVLYK

SEQ ID NO: 3067 - protein, 11 aa, Artificial Sequence
  GFR-binding peptide
QALSPISILYI

SEQ ID NO: 3068 - protein, 17 aa, Artificial Sequence
  GFR-binding peptide
  MOD_RES (4)..(4): Xaa is C or S
KPTXAPTKLSPISVLYI

SEQ ID NO: 3069 - protein, 13 aa, Artificial Sequence
  GFR-binding peptide
VSQDLSPISILYK

SEQ ID NO: 3070 - protein, 16 aa, Artificial Sequence
  GFR-binding peptide
  MOD_RES (2)..(3): Xaa is C or S
PXXVPQDLNAISILYF

SEQ ID NO: 3071 - protein, 9 aa, Artificial Sequence
  GFR-binding peptide
LSPISILYK

SEQ ID NO: 3072 - protein, 20 aa, Artificial Sequence
  GFR-binding peptide
  MOD_RES (6)..(7): Xaa is C or S
AVPKAXXAPTKLEPISVLYL

SEQ ID NO: 3073 - protein, 15 aa, Artificial Sequence
  GFR-binding peptide
  MOD_RES (1)..(2): Xaa is C or S
XXVPQALSPISILYK

SEQ ID NO: 3074 - protein, 16 aa, Artificial Sequence
  GFR-binding peptide
  MOD_RES (2)..(3): Xaa is C or S
PXXAPTQLSPISVLYK

SEQ ID NO: 3075 - protein, 16 aa, Artificial Sequence
  GFR-binding peptide
  MOD_RES (2)..(3): Xaa is C or S
PXXAPTQLSPISVLYI

SEQ ID NO: 3076 - protein, 18 aa, Artificial Sequence
  GFR-binding peptide
  MOD_RES (4)..(5): Xaa is C or S
AAPXXVPQALEPISILYL

SEQ ID NO: 3077 - protein, 15 aa, Artificial Sequence
  GFR-binding peptide
  MOD_RES (1)..(2): Xaa is C or S
XXVPQALSPISILYI

SEQ ID NO: 3078 - protein, 12 aa, Artificial Sequence
  GFR-binding peptide
PTKLEPISVLYL

SEQ ID NO: 3079 - protein, 15 aa, Artificial Sequence
  GFR-binding peptide
  MOD_RES (1)..(2): Xaa is C or S
XXVPTKLSPISILYI

SEQ ID NO: 3080 - protein, 15 aa, Artificial Sequence
  GFR-binding peptide
  MOD_RES (1)..(2): Xaa is C or S
XXVPTKLSPISILYK

SEQ ID NO: 3081 - protein, 19 aa, Artificial Sequence
  GFR-binding peptide
  MOD_RES (5)..(6): Xaa is C or S
SASPXXVSQDLNAISILYF

SEQ ID NO: 3082 - protein, 17 aa, Artificial Sequence
  GFR-binding peptide
  MOD_RES (3)..(4): Xaa is C or S
SPXXVPQDLEPISILYL

SEQ ID NO: 3083 - protein, 18 aa, Artificial Sequence
  GFR-binding peptide
  MOD_RES (4)..(5): Xaa is C or S
AAPXXVPQALSPISILYK

SEQ ID NO: 3084 - protein, 14 aa, Artificial Sequence
  GFR-binding peptide
  MOD_RES (1)..(1): Xaa is C or S
XVPARLEPISILYL

SEQ ID NO: 3085 - protein, 18 aa, Artificial Sequence
  GFR-binding peptide
  MOD_RES (4)..(5): Xaa is C or S
AAPXXVPQALSPISILYI

SEQ ID NO: 3086 - protein, 14 aa, Artificial Sequence
  GFR-binding peptide
  MOD_RES (1)..(1): Xaa is C or S
XVPTELEPISMLYL

SEQ ID NO: 3087 - protein, 16 aa, Artificial Sequence
  GFR-binding peptide
  MOD_RES (2)..(3): Xaa is C or S
PXXVPQALNAISILYF

SEQ ID NO: 3088 - protein, 16 aa, Artificial Sequence
  GFR-binding peptide
  MOD_RES (2)..(3): Xaa is C or S
PXXVSQDLEPISILYL

SEQ ID NO: 3089 - protein, 14 aa, Artificial Sequence
  GFR-binding peptide
  MOD_RES (1)..(1): Xaa is C or S
XAPTKLSPISVLYK

SEQ ID NO: 3090 - protein, 14 aa, Artificial Sequence
  GFR-binding peptide
  MOD_RES (1)..(1): Xaa is C or S
XAPTKLSPISVLYI

SEQ ID NO: 3091 - protein, 16 aa, Artificial Sequence
  GFR-binding peptide
  MOD_RES (2)..(3): Xaa is C or S
PXXVPQALEPISILYL

SEQ ID NO: 3092 - protein, 18 aa, Artificial Sequence
  GFR-binding peptide
  MOD_RES (4)..(5): Xaa is C or S
PKPXXAPTQLSPISVLYI

SEQ ID NO: 3093 - protein, 10 aa, Artificial Sequence
  GFR-binding peptide
KLNAISILYF

SEQ ID NO: 3094 - protein, 18 aa, Artificial Sequence
  GFR-binding peptide
  MOD_RES (4)..(5): Xaa is C or S
PKPXXAPTQLSPISVLYK

SEQ ID NO: 3095 - protein, 13 aa, Artificial Sequence
  GFR-binding peptide
APTQLSPISVLYI

SEQ ID NO: 3096 - protein, 13 aa, Artificial Sequence
  GFR-binding peptide
APTQLSPISVLYK

SEQ ID NO: 3097 - protein, 13 aa, Artificial Sequence
  GFR-binding peptide
VPTKLSPISILYI

SEQ ID NO: 3098 - protein, 10 aa, Artificial Sequence
  GFR-binding peptide
ALSPISILYI

SEQ ID NO: 3099 - protein, 13 aa, Artificial Sequence
  GFR-binding peptide
VPTKLSPISILYK

SEQ ID NO: 3100 - protein, 14 aa, Artificial Sequence
  GFR-binding peptide
  MOD_RES (1)..(1): Xaa is C or S
XVPTKLEPISVLYL

SEQ ID NO: 3101 - protein, 10 aa, Artificial Sequence
  GFR-binding peptide
ALSPISILYK

SEQ ID NO: 3102 - protein, 16 aa, Artificial Sequence
  GFR-binding peptide
  MOD_RES (2)..(3): Xaa is C or S
AXXAPTKLEPISVLYL

SEQ ID NO: 3103 - protein, 17 aa, Artificial Sequence
  GFR-binding peptide
  MOD_RES (3)..(4): Xaa is C or S
KAXXAPTKLSPISVLYK

SEQ ID NO: 3104 - protein, 10 aa, Artificial Sequence
  GFR-binding peptide
RLSPISILYK

SEQ ID NO: 3105 - protein, 17 aa, Artificial Sequence
  GFR-binding peptide
  MOD_RES (3)..(4): Xaa is C or S
KAXXAPTKLSPISVLYI

SEQ ID NO: 3106 - protein, 13 aa, Artificial Sequence
  GFR-binding peptide
VPQALSPISILYI

SEQ ID NO: 3107 - protein, 12 aa, Artificial Sequence
  GFR-binding peptide
PQDLSPISILYK

SEQ ID NO: 3108 - protein, 13 aa, Artificial Sequence
  GFR-binding peptide
VPQALSPISILYK

SEQ ID NO: 3109 - protein, 15 aa, Artificial Sequence
  GFR-binding peptide
  MOD_RES (1)..(2): Xaa is C or S
XXAPTQLSPISVLYI

SEQ ID NO: 3110 - protein, 15 aa, Artificial Sequence
  GFR-binding peptide
  MOD_RES (1)..(2): Xaa is C or S
XXAPTQLSPISVLYK

SEQ ID NO: 3111 - protein, 12 aa, Artificial Sequence
  GFR-binding peptide
PQDLSPISILYI

SEQ ID NO: 3112 - protein, 15 aa, Artificial Sequence
  GFR-binding peptide
  MOD_RES (1)..(2): Xaa is C or S
XXVPTELNAISMLYF

SEQ ID NO: 3113 - protein, 15 aa, Artificial Sequence
  GFR-binding peptide
  MOD_RES (1)..(2): Xaa is C or S
XXVSQDLEPISILYL

SEQ ID NO: 3114 - protein, 14 aa, Artificial Sequence
  GFR-binding peptide
  MOD_RES (1)..(1): Xaa is C or S
XVPQDLSPISILYI

SEQ ID NO: 3115 - protein, 13 aa, Artificial Sequence
  GFR-binding peptide
VSQDLEPISILYL

SEQ ID NO: 3116 - protein, 14 aa, Artificial Sequence
  GFR-binding peptide
  MOD_RES (1)..(1): Xaa is C or S
XVPQDLSPISILYK

SEQ ID NO: 3117 - protein, 18 aa, Artificial Sequence
  GFR-binding peptide
  MOD_RES (4)..(5): Xaa is C or S
PASXXVPARLEPISILYL

SEQ ID NO: 3118 - protein, 19 aa, Artificial Sequence
  GFR-binding peptide
  MOD_RES (6)..(6): Xaa is C or S
VTKPTXAPTKLSPISVLYI

SEQ ID NO: 3119 - protein, 19 aa, Artificial Sequence
  GFR-binding peptide
  MOD_RES (6)..(6): Xaa is C or S
VTKPTXAPTKLSPISVLYK

SEQ ID NO: 3120 - protein, 18 aa, Artificial Sequence
  GFR-binding peptide
  MOD_RES (5)..(5): Xaa is C or S
TKPTXAPTKLSPISVLYI

SEQ ID NO: 3121 - protein, 18 aa, Artificial Sequence
  GFR-binding peptide
  MOD_RES (4)..(5): Xaa is C or S
PKAXXAPTKLSPISVLYK

SEQ ID NO: 3122 - protein, 18 aa, Artificial Sequence
  GFR-binding peptide
  MOD_RES (4)..(5): Xaa is C or S
PKAXXAPTKLSPISVLYI

SEQ ID NO: 3123 - protein, 10 aa, Artificial Sequence
  GFR-binding peptide
QLEPISVLYL

SEQ ID NO: 3124 - protein, 15 aa, Artificial Sequence
  GFR-binding peptide
  MOD_RES (1)..(2): Xaa is C or S
XXVPQDLSPISILYI

SEQ ID NO: 3125 - protein, 15 aa, Artificial Sequence
  GFR-binding peptide
  MOD_RES (1)..(2): Xaa is C or S
XXVPQDLSPISILYK

SEQ ID NO: 3126 - protein, 13 aa, Artificial Sequence
  GFR-binding peptide
VPTELNAISMLYF

SEQ ID NO: 3127 - protein, 20 aa, Artificial Sequence
  GFR-binding peptide
  MOD_RES (6)..(7): Xaa is C or S
ASAAPXXVPQALSPISILYK

SEQ ID NO: 3128 - protein, 20 aa, Artificial Sequence
  GFR-binding peptide
  MOD_RES (6)..(7): Xaa is C or S
KIPKAXXVPTELSPISMLYK

SEQ ID NO: 3129 - protein, 20 aa, Artificial Sequence
  GFR-binding peptide
  MOD_RES (6)..(7): Xaa is C or S
KIPKAXXVPTELSPISMLYI

SEQ ID NO: 3130 - protein, 16 aa, Artificial Sequence
  GFR-binding peptide
  MOD_RES (2)..(3): Xaa is C or S
AXXVPTKLSPISVLYI

SEQ ID NO: 3131 - protein, 18 aa, Artificial Sequence
  GFR-binding peptide
  MOD_RES (4)..(5): Xaa is C or S
SKAXXVPTKLNAISILYF

SEQ ID NO: 3132 - protein, 12 aa, Artificial Sequence
  GFR-binding peptide
SQDLSPISILYI

SEQ ID NO: 3133 - protein, 19 aa, Artificial Sequence
  GFR-binding peptide
  MOD_RES (5)..(6): Xaa is C or S
SASPXXVSQDLEPISILYL

SEQ ID NO: 3134 - protein, 12 aa, Artificial Sequence
  GFR-binding peptide
SQDLSPISILYK

SEQ ID NO: 3135 - protein, 17 aa, Artificial Sequence
  GFR-binding peptide
  MOD_RES (3)..(4): Xaa is C or S
KPXXAPTKLSPISVLYI

SEQ ID NO: 3136 - protein, 17 aa, Artificial Sequence
  GFR-binding peptide
  MOD_RES (3)..(4): Xaa is C or S
KPXXAPTKLSPISVLYK

SEQ ID NO: 3137 - protein, 17 aa, Artificial Sequence
  GFR-binding peptide
  MOD_RES (3)..(4): Xaa is C or S
KPXXAPTQLSPISVLYI

SEQ ID NO: 3138 - protein, 12 aa, Artificial Sequence
  GFR-binding peptide
PTELEPISMLYL

SEQ ID NO: 3139 - protein, 17 aa, Artificial Sequence
  GFR-binding peptide
  MOD_RES (3)..(4): Xaa is C or S
KPXXAPTQLSPISVLYK

SEQ ID NO: 3140 - protein, 16 aa, Artificial Sequence
  GFR-binding peptide
  MOD_RES (2)..(3): Xaa is C or S
PXXVSQDLNAISILYF

SEQ ID NO: 3141 - protein, 14 aa, Artificial Sequence
  GFR-binding peptide
  MOD_RES (1)..(1): Xaa is C or S
XVPQALSPISILYK

SEQ ID NO: 3142 - protein, 14 aa, Artificial Sequence
  GFR-binding peptide
  MOD_RES (1)..(1): Xaa is C or S
XVPARLNAISILYF

SEQ ID NO: 3143 - protein, 14 aa, Artificial Sequence
  GFR-binding peptide
  MOD_RES (1)..(1): Xaa is C or S
XVPTELNAISMLYF

SEQ ID NO: 3144 - protein, 14 aa, Artificial Sequence
  GFR-binding peptide
  MOD_RES (1)..(1): Xaa is C or S
XVPQALSPISILYI

SEQ ID NO: 3145 - protein, 20 aa, Artificial Sequence
  GFR-binding peptide
  MOD_RES (6)..(7): Xaa is C or S
ASASPXXVPQDLNAISILYF

SEQ ID NO: 3146 - protein, 19 aa, Artificial Sequence
  GFR-binding peptide
  MOD_RES (5)..(6): Xaa is C or S
VGKAXXVPTKLSPISVLYI

SEQ ID NO: 3147 - protein, 18 aa, Artificial Sequence
  GFR-binding peptide
  MOD_RES (5)..(5): Xaa is C or S
TKPTXAPTKLSPISVLYK

SEQ ID NO: 3148 - protein, 18 aa, Artificial Sequence
  GFR-binding peptide
  MOD_RES (4)..(5): Xaa is C or S
PKPXXAPTKLSPISVLYK

SEQ ID NO: 3149 - protein, 14 aa, Artificial Sequence
  GFR-binding peptide
  MOD_RES (1)..(1): Xaa is C or S
XVPTKLNAISVLYF

SEQ ID NO: 3150 - protein, 18 aa, Artificial Sequence
  GFR-binding peptide
  MOD_RES (4)..(5): Xaa is C or S
PKPXXAPTKLSPISVLYI

SEQ ID NO: 3151 - protein, 10 aa, Artificial Sequence
  GFR-binding peptide
DLSPISILYK

SEQ ID NO: 3152 - protein, 19 aa, Artificial Sequence
  GFR-binding peptide
  MOD_RES (5)..(6): Xaa is C or S
IPKAXXVPTELEPISMLYL

SEQ ID NO: 3153 - protein, 10 aa, Artificial Sequence
  GFR-binding peptide
DLSPISILYI

SEQ ID NO: 3154 - protein, 13 aa, Artificial Sequence
  GFR-binding peptide
APTKLSPISVLYK

SEQ ID NO: 3155 - protein, 20 aa, Artificial Sequence
  GFR-binding peptide
  MOD_RES (7)..(7): Xaa is C or S
HVTKPTXAPTKLSPISVLYI

SEQ ID NO: 3156 - protein, 13 aa, Artificial Sequence
  GFR-binding peptide
APTKLSPISVLYI

SEQ ID NO: 3157 - protein, 20 aa, Artificial Sequence
  GFR-binding peptide
  MOD_RES (6)..(7): Xaa is C or S
YVPKPXXAPTKLEPISVLYL

SEQ ID NO: 3158 - protein, 11 aa, Artificial Sequence
  GFR-binding peptide
TKLSPISILYK

SEQ ID NO: 3159 - protein, 17 aa, Artificial Sequence
  GFR-binding peptide
  MOD_RES (3)..(4): Xaa is C or S
KAXXVPTKLSPISILYK

SEQ ID NO: 3160 - protein, 17 aa, Artificial Sequence
  GFR-binding peptide
  MOD_RES (3)..(4): Xaa is C or S
KAXXVPTKLSPISILYI

SEQ ID NO: 3161 - protein, 12 aa, Artificial Sequence
  GFR-binding peptide
PTQLEPISVLYL

SEQ ID NO: 3162 - protein, 11 aa, Artificial Sequence
  GFR-binding peptide
TKLSPISILYI

SEQ ID NO: 3163 - protein, 10 aa, Artificial Sequence
  GFR-binding peptide
KLEPISVLYL

SEQ ID NO: 3164 - protein, 17 aa, Artificial Sequence
  GFR-binding peptide
  MOD_RES (3)..(4): Xaa is C or S
SPXXVSQDLNAISILYF

SEQ ID NO: 3165 - protein, 16 aa, Artificial Sequence
  GFR-binding peptide
  MOD_RES (2)..(3): Xaa is C or S
AXXVPTELSPINMLYF

SEQ ID NO: 3166 - protein, 13 aa, Artificial Sequence
  GFR-binding peptide
APTKLSPINVLYF

SEQ ID NO: 3167 - protein, 14 aa, Artificial Sequence
  GFR-binding peptide
  MOD_RES (1)..(1): Xaa is C or S
XVPTKLSPINILYF

SEQ ID NO: 3168 - protein, 16 aa, Artificial Sequence
  GFR-binding peptide
  MOD_RES (2)..(3): Xaa is C or S
SXXVPARLSPINILYF

SEQ ID NO: 3169 - protein, 15 aa, Artificial Sequence
  GFR-binding peptide
  MOD_RES (1)..(2): Xaa is C or S
XXAPVKTSPINMLYF

SEQ ID NO: 3170 - protein, 14 aa, Artificial Sequence
  GFR-binding peptide
  MOD_RES (1)..(1): Xaa is C or S
XAPTQLSPINVLYF

SEQ ID NO: 3171 - protein, 19 aa, Artificial Sequence
  GFR-binding peptide
  MOD_RES (5)..(6): Xaa is C or S
IPKAXXVPTELSPINMLYF

SEQ ID NO: 3172 - protein, 13 aa, Artificial Sequence
  GFR-binding peptide
VPTRLSPINILYF

SEQ ID NO: 3173 - protein, 20 aa, Artificial Sequence
  GFR-binding peptide
  MOD_RES (6)..(7): Xaa is C or S
AAPASXXVPARLSPINILYF

SEQ ID NO: 3174 - protein, 13 aa, Artificial Sequence
  GFR-binding peptide
VPTKLSPINVLYF

SEQ ID NO: 3175 - protein, 17 aa, Artificial Sequence
  GFR-binding peptide
  MOD_RES (3)..(4): Xaa is C or S
KAXXAPTKLSPINVLYF

SEQ ID NO: 3176 - protein, 10 aa, Artificial Sequence
  GFR-binding peptide
QLSPINVLYF

SEQ ID NO: 3177 - protein, 10 aa, Artificial Sequence
  GFR-binding peptide
RLSPINILYF

SEQ ID NO: 3178 - protein, 10 aa, Artificial Sequence
  GFR-binding peptide
KLSPINVLYF

SEQ ID NO: 3179 - protein, 15 aa, Artificial Sequence
  GFR-binding peptide
  MOD_RES (1)..(2): Xaa is C or S
XXVPTELSPINMLYF

SEQ ID NO: 3180 - protein, 16 aa, Artificial Sequence
  GFR-binding peptide
  MOD_RES (2)..(3): Xaa is C or S
TXXVPTRLSPINILYF

SEQ ID NO: 3181 - protein, 14 aa, Artificial Sequence
  GFR-binding peptide
  MOD_RES (1)..(1): Xaa is C or S
XVPTRLSPINILYF

SEQ ID NO: 3182 - protein, 17 aa, Artificial Sequence
  GFR-binding peptide
  MOD_RES (4)..(4): Xaa is C or S
KPTXAPTKLSPINVLYF

SEQ ID NO: 3183 - protein, 20 aa, Artificial Sequence
  GFR-binding peptide
  MOD_RES (6)..(7): Xaa is C or S
KASKAXXVPTKLSPINILYF

SEQ ID NO: 3184 - protein, 11 aa, Artificial Sequence
  GFR-binding peptide
TELSPINMLYF

SEQ ID NO: 3185 - protein, 11 aa, Artificial Sequence
  GFR-binding peptide
ARLSPINILYF

SEQ ID NO: 3186 - protein, 13 aa, Artificial Sequence
  GFR-binding peptide
VPTKLSPINILYF

SEQ ID NO: 3187 - protein, 19 aa, Artificial Sequence
  GFR-binding peptide
  MOD_RES (6)..(6): Xaa is C or S
VTKPTXAPTKLSPINVLYF

SEQ ID NO: 3188 - protein, 17 aa, Artificial Sequence
  GFR-binding peptide
  MOD_RES (3)..(4): Xaa is C or S
PTXXVPTRLSPINILYF

SEQ ID NO: 3189 - protein, 13 aa, Artificial Sequence
  GFR-binding peptide
APTQLSPINVLYF

SEQ ID NO: 3190 - protein, 9 aa, Artificial Sequence
  GFR-binding peptide
LSPINMLYF

SEQ ID NO: 3191 - protein, 16 aa, Artificial Sequence
  GFR-binding peptide
  MOD_RES (2)..(3): Xaa is C or S
TXXAPVKTSPINMLYF

SEQ ID NO: 3192 - protein, 20 aa, Artificial Sequence
  GFR-binding peptide
  MOD_RES (6)..(7): Xaa is C or S
TVPKPXXAPTQLSPINVLYF

SEQ ID NO: 3193 - protein, 12 aa, Artificial Sequence
  GFR-binding peptide
PTKLSPINILYF

SEQ ID NO: 3194 - protein, 20 aa, Artificial Sequence
  GFR-binding peptide
  MOD_RES (6)..(7): Xaa is C or S
KVGKAXXVPTKLSPINVLYF

SEQ ID NO: 3195 - protein, 12 aa, Artificial Sequence
  GFR-binding peptide
PTELSPINMLYF

SEQ ID NO: 3196 - protein, 14 aa, Artificial Sequence
  GFR-binding peptide
  MOD_RES (1)..(1): Xaa is C or S
XVPTKLSPINVLYF

SEQ ID NO: 3197 - protein, 18 aa, Artificial Sequence
  GFR-binding peptide
  MOD_RES (4)..(5): Xaa is C or S
PKAXXVPTELSPINMLYF

SEQ ID NO: 3198 - protein, 16 aa, Artificial Sequence
  GFR-binding peptide
  MOD_RES (2)..(3): Xaa is C or S
PXXAPTKLSPINVLYF

SEQ ID NO: 3199 - protein, 18 aa, Artificial Sequence
  GFR-binding peptide
  MOD_RES (5)..(5): Xaa is C or S
TKPTXAPTKLSPINVLYF

SEQ ID NO: 3200 - protein, 19 aa, Artificial Sequence
  GFR-binding peptide
  MOD_RES (5)..(6): Xaa is C or S
VPKAXXAPTKLSPINVLYF

SEQ ID NO: 3201 - protein, 15 aa, Artificial Sequence
  GFR-binding peptide
  MOD_RES (1)..(2): Xaa is C or S
XXVPARLSPINILYF

SEQ ID NO: 3202 - protein, 13 aa, Artificial Sequence
  GFR-binding peptide
APVKTSPINMLYF

SEQ ID NO: 3203 - protein, 12 aa, Artificial Sequence
  GFR-binding peptide
PVKTSPINMLYF

SEQ ID NO: 3204 - protein, 17 aa, Artificial Sequence
  GFR-binding peptide
  MOD_RES (3)..(4): Xaa is C or S
KPXXAPTQLSPINVLYF

SEQ ID NO: 3205 - protein, 11 aa, Artificial Sequence
  GFR-binding peptide
TQLSPINVLYF

SEQ ID NO: 3206 - protein, 14 aa, Artificial Sequence
  GFR-binding peptide
  MOD_RES (1)..(1): Xaa is C or S
XVPTELSPINMLYF

SEQ ID NO: 3207 - protein, 18 aa, Artificial Sequence
  GFR-binding peptide
  MOD_RES (4)..(5): Xaa is C or S
PSTXXAPVKTSPINMLYF

SEQ ID NO: 3208 - protein, 19 aa, Artificial Sequence
  GFR-binding peptide
  MOD_RES (5)..(6): Xaa is C or S
VPKPXXAPTQLSPINVLYF

SEQ ID NO: 3209 - protein, 16 aa, Artificial Sequence
  GFR-binding peptide
  MOD_RES (2)..(3): Xaa is C or S
AXXVPTKLSPINVLYF

SEQ ID NO: 3210 - protein, 10 aa, Artificial Sequence
  GFR-binding peptide
KTSPINMLYF

SEQ ID NO: 3211 - protein, 18 aa, Artificial Sequence
  GFR-binding peptide
  MOD_RES (4)..(5): Xaa is C or S
PPTXXVPTRLSPINILYF

SEQ ID NO: 3212 - protein, 18 aa, Artificial Sequence
  GFR-binding peptide
  MOD_RES (4)..(5): Xaa is C or S
PKPXXAPTQLSPINVLYF

SEQ ID NO: 3213 - protein, 18 aa, Artificial Sequence
  GFR-binding peptide
  MOD_RES (4)..(5): Xaa is C or S
PKPXXAPTKLSPINVLYF

SEQ ID NO: 3214 - protein, 16 aa, Artificial Sequence
  GFR-binding peptide
  MOD_RES (2)..(3): Xaa is C or S
AXXAPTKLSPINVLYF

SEQ ID NO: 3215 - protein, 18 aa, Artificial Sequence
  GFR-binding peptide
  MOD_RES (4)..(5): Xaa is C or S
SKAXXVPTKLSPINILYF

SEQ ID NO: 3216 - protein, 13 aa, Artificial Sequence
  GFR-binding peptide
VPTELSPINMLYF

SEQ ID NO: 3217 - protein, 16 aa, Artificial Sequence
  GFR-binding peptide
  MOD_RES (2)..(3): Xaa is C or S
AXXVPTKLSPINILYF

SEQ ID NO: 3218 - protein, 13 aa, Artificial Sequence
  GFR-binding peptide
VPARLSPINILYF

SEQ ID NO: 3219 - protein, 11 aa, Artificial Sequence
  GFR-binding peptide
TRLSPINILYF

SEQ ID NO: 3220 - protein, 20 aa, Artificial Sequence
  GFR-binding peptide
  MOD_RES (6)..(7): Xaa is C or S
HVPKPXXAPTKLSPINVLYF

SEQ ID NO: 3221 - protein, 15 aa, Artificial Sequence
  GFR-binding peptide
  MOD_RES (1)..(2): Xaa is C or S
XXVPTRLSPINILYF

SEQ ID NO: 3222 - protein, 9 aa, Artificial Sequence
  GFR-binding peptide
LSPINVLYF

SEQ ID NO: 3223 - protein, 16 aa, Artificial Sequence
  GFR-binding peptide
  MOD_RES (3)..(3): Xaa is C or S
PTXAPTKLSPINVLYF

SEQ ID NO: 3224 - protein, 15 aa, Artificial Sequence
  GFR-binding peptide
  MOD_RES (1)..(2): Xaa is C or S
XXVPTKLSPINVLYF

SEQ ID NO: 3225 - protein, 15 aa, Artificial Sequence
  GFR-binding peptide
  MOD_RES (1)..(2): Xaa is C or S
XXAPTKLSPINVLYF

SEQ ID NO: 3226 - protein, 12 aa, Artificial Sequence
  GFR-binding peptide
PTRLSPINILYF

SEQ ID NO: 3227 - protein, 11 aa, Artificial Sequence
  GFR-binding peptide
VKTSPINMLYF

SEQ ID NO: 3228 - protein, 17 aa, Artificial Sequence
  GFR-binding peptide
  MOD_RES (3)..(4): Xaa is C or S
KAXXVPTELSPINMLYF

SEQ ID NO: 3229 - protein, 15 aa, Artificial Sequence
  GFR-binding peptide
  MOD_RES (1)..(2): Xaa is C or S
XXVPTKLSPINILYF

SEQ ID NO: 3230 - protein, 12 aa, Artificial Sequence
  GFR-binding peptide
PTQLSPINVLYF

SEQ ID NO: 3231 - skipped

SEQ ID NO: 3232 - protein, 11 aa, Artificial Sequence
  GFR-binding peptide
TKLSPINILYF

SEQ ID NO: 3233 - protein, 12 aa, Artificial Sequence
  GFR-binding peptide
PTKLSPINVLYF

SEQ ID NO: 3234 - protein, 18 aa, Artificial Sequence
  GFR-binding peptide
  MOD_RES (4)..(5): Xaa is C or S
GKAXXVPTKLSPINVLYF

SEQ ID NO: 3235 - protein, 19 aa, Artificial Sequence
  GFR-binding peptide
  MOD_RES (5)..(6): Xaa is C or S
VPSTXXAPVKTSPINMLYF

SEQ ID NO: 3236 - protein, 15 aa, Artificial Sequence
  GFR-binding peptide
  MOD_RES (1)..(2): Xaa is C or S
XXAPTQLSPINVLYF

SEQ ID NO: 3237 - protein, 9 aa, Artificial Sequence
  GFR-binding peptide
LSPINILYF

SEQ ID NO: 3238 - protein, 17 aa, Artificial Sequence
  GFR-binding peptide
  MOD_RES (3)..(4): Xaa is C or S
STXXAPVKTSPINMLYF

SEQ ID NO: 3239 - protein, 15 aa, Artificial Sequence
  GFR-binding peptide
  MOD_RES (2)..(2): Xaa is C or S
TXAPTKLSPINVLYF

SEQ ID NO: 3240 - protein, 12 aa, Artificial Sequence
  GFR-binding peptide
PARLSPINILYF

SEQ ID NO: 3241 - protein, 16 aa, Artificial Sequence
  GFR-binding peptide
  MOD_RES (2)..(3): Xaa is C or S
PXXAPTQLSPINVLYF

SEQ ID NO: 3242 - protein, 20 aa, Artificial Sequence
  GFR-binding peptide
  MOD_RES (6)..(7): Xaa is C or S
YVPKPXXAPTKLSPINVLYF

SEQ ID NO: 3243 - protein, 10 aa, Artificial Sequence
  GFR-binding peptide
ELSPINMLYF

SEQ ID NO: 3244 - protein, 18 aa, Artificial Sequence
  GFR-binding peptide
  MOD_RES (4)..(5): Xaa is C or S
PKAXXAPTKLSPINVLYF

SEQ ID NO: 3245 - protein, 18 aa, Artificial Sequence
  GFR-binding peptide
  MOD_RES (4)..(5): Xaa is C or S
PASXXVPARLSPINILYF

SEQ ID NO: 3246 - protein, 19 aa, Artificial Sequence
  GFR-binding peptide
  MOD_RES (5)..(6): Xaa is C or S
APASXXVPARLSPINILYF

SEQ ID NO: 3247 - protein, 14 aa, Artificial Sequence
  GFR-binding peptide
  MOD_RES (1)..(1): Xaa is C or S
XAPVKTSPINMLYF

SEQ ID NO: 3248 - protein, 17 aa, Artificial Sequence
  GFR-binding peptide
  MOD_RES (3)..(4): Xaa is C or S
KAXXVPTKLSPINILYF

SEQ ID NO: 3249 - protein, 10 aa, Artificial Sequence
  GFR-binding peptide
KLSPINILYF

SEQ ID NO: 3250 - protein, 11 aa, Artificial Sequence
  GFR-binding peptide
TKLSPINVLYF

SEQ ID NO: 3251 - protein, 17 aa, Artificial Sequence
  GFR-binding peptide
  MOD_RES (3)..(4): Xaa is C or S
KPXXAPTKLSPINVLYF

SEQ ID NO: 3252 - protein, 20 aa, Artificial Sequence
  GFR-binding peptide
  MOD_RES (6)..(7): Xaa is C or S
STPPTXXVPTRLSPINILYF

SEQ ID NO: 3253 - protein, 9 aa, Artificial Sequence
  GFR-binding peptide
TSPINMLYF

SEQ ID NO: 3254 - protein, 19 aa, Artificial Sequence
  GFR-binding peptide
  MOD_RES (5)..(6): Xaa is C or S
VGKAXXVPTKLSPINVLYF

SEQ ID NO: 3255 - protein, 17 aa, Artificial Sequence
  GFR-binding peptide
  MOD_RES (3)..(4): Xaa is C or S
ASXXVPARLSPINILYF

SEQ ID NO: 3256 - protein, 14 aa, Artificial Sequence
  GFR-binding peptide
  MOD_RES (1)..(1): Xaa is C or S
XAPTKLSPINVLYF

SEQ ID NO: 3257 - protein, 20 aa, Artificial Sequence
  GFR-binding peptide
  MOD_RES (7)..(7): Xaa is C or S
HVTKPTXAPTKLSPINVLYF

SEQ ID NO: 3258 - protein, 20 aa, Artificial Sequence
  GFR-binding peptide
  MOD_RES (6)..(7): Xaa is C or S
AVPKAXXAPTKLSPINVLYF

SEQ ID NO: 3259 - protein, 14 aa, Artificial Sequence
  GFR-binding peptide
  MOD_RES (1)..(1): Xaa is C or S
XVPARLSPINILYF

SEQ ID NO: 3260 - protein, 19 aa, Artificial Sequence
  GFR-binding peptide
  MOD_RES (5)..(6): Xaa is C or S
TPPTXXVPTRLSPINILYF

SEQ ID NO: 3261 - protein, 19 aa, Artificial Sequence
  GFR-binding peptide
  MOD_RES (5)..(6): Xaa is C or S
VPKPXXAPTKLSPINVLYF

SEQ ID NO: 3262 - protein, 19 aa, Artificial Sequence
  GFR-binding peptide
  MOD_RES (5)..(6): Xaa is C or S
ASKAXXVPTKLSPINILYF

SEQ ID NO: 3263 - protein, 17 aa, Artificial Sequence
  GFR-binding peptide
  MOD_RES (3)..(4): Xaa is C or S
KAXXVPTKLSPINVLYF

SEQ ID NO: 3264 - protein, 16 aa, Artificial Sequence
  GFR-binding peptide
  MOD_RES (2)..(3): Xaa is C or S
AXXVPTELSPINMLYF

SEQ ID NO: 3265 - protein, 13 aa, Artificial Sequence
  GFR-binding peptide
APTKLSPINVLYF

SEQ ID NO: 3266 - protein, 14 aa, Artificial Sequence
  GFR-binding peptide
  MOD_RES (1)..(1): Xaa is C or S
XVPTKLSPINILYF

SEQ ID NO: 3267 - protein, 16 aa, Artificial Sequence
  GFR-binding peptide
  MOD_RES (2)..(3): Xaa is C or S
SXXVPARLSPINILYF

SEQ ID NO: 3268 - protein, 15 aa, Artificial Sequence
  GFR-binding peptide
  MOD_RES (1)..(2): Xaa is C or S
XXAPVKTSPINMLYF

SEQ ID NO: 3269 - protein, 14 aa, Artificial Sequence
  GFR-binding peptide
  MOD_RES (1)..(1): Xaa is C or S
XAPTQLSPINVLYF

SEQ ID NO: 3270 - protein, 19 aa, Artificial Sequence
  GFR-binding peptide
  MOD_RES (5)..(6): Xaa is C or S
IPKAXXVPTELSPINMLYF

SEQ ID NO: 3271 - protein, 13 aa, Artificial Sequence
  GFR-binding peptide
VPTRLSPINILYF

SEQ ID NO: 3272 - protein, 20 aa, Artificial Sequence
  GFR-binding peptide
  MOD_RES (6)..(7): Xaa is C or S
AAPASXXVPARLSPINILYF

SEQ ID NO: 3273 - protein, 13 aa, Artificial Sequence
  GFR-binding peptide
VPTKLSPINVLYF

SEQ ID NO: 3274 - protein, 17 aa, Artificial Sequence
  GFR-binding peptide
  MOD_RES (3)..(4): Xaa is C or S
KAXXAPTKLSPINVLYF

SEQ ID NO: 3275 - protein, 10 aa, Artificial Sequence
  GFR-binding peptide
QLSPINVLYF

SEQ ID NO: 3276 - protein, 10 aa, Artificial Sequence
  GFR-binding peptide
RLSPINILYF

SEQ ID NO: 3277 - protein, 10 aa, Artificial Sequence
  GFR-binding peptide
KLSPINVLYF

SEQ ID NO: 3278 - protein, 15 aa, Artificial Sequence
  GFR-binding peptide
  MOD_RES (1)..(2): Xaa is C or S
XXVPTELSPINMLYF

SEQ ID NO: 3279 - protein, 16 aa, Artificial Sequence
  GFR-binding peptide
  MOD_RES (2)..(3): Xaa is C or S
TXXVPTRLSPINILYF

SEQ ID NO: 3280 - protein, 14 aa, Artificial Sequence
  GFR-binding peptide
  MOD_RES (1)..(1): Xaa is C or S
XVPTRLSPINILYF

SEQ ID NO: 3281 - protein, 17 aa, Artificial Sequence
  GFR-binding peptide
  MOD_RES (4)..(4): Xaa is C or S
KPTXAPTKLSPINVLYF

SEQ ID NO: 3282 - protein, 20 aa, Artificial Sequence
  GFR-binding peptide
  MOD_RES (6)..(7): Xaa is C or S
KASKAXXVPTKLSPINILYF

SEQ ID NO: 3283 - protein, 11 aa, Artificial Sequence
  GFR-binding peptide
TELSPINMLYF

SEQ ID NO: 3284 - protein, 11 aa, Artificial Sequence
  GFR-binding peptide
ARLSPINILYF

SEQ ID NO: 3285 - protein, 13 aa, Artificial Sequence
  GFR-binding peptide
VPTKLSPINILYF

SEQ ID NO: 3286 - protein, 19 aa, Artificial Sequence
  GFR-binding peptide
  MOD_RES (6)..(6): Xaa is C or S
VTKPTXAPTKLSPINVLYF

SEQ ID NO: 3287 - protein, 17 aa, Artificial Sequence
  GFR-binding peptide
  MOD_RES (3)..(4): Xaa is C or S
PTXXVPTRLSPINILYF

SEQ ID NO: 3288 - protein, 13 aa, Artificial Sequence
  GFR-binding peptide
APTQLSPINVLYF

SEQ ID NO: 3289 - protein, 9 aa, Artificial Sequence
  GFR-binding peptide
LSPINMLYF

SEQ ID NO: 3290 - protein, 16 aa, Artificial Sequence
  GFR-binding peptide
  MOD_RES (2)..(3): Xaa is C or S
TXXAPVKTSPINMLYF

SEQ ID NO: 3291 - protein, 20 aa, Artificial Sequence
  GFR-binding peptide
  MOD_RES (6)..(7): Xaa is C or S
TVPKPXXAPTQLSPINVLYF

SEQ ID NO: 3292 - protein, 12 aa, Artificial Sequence
  GFR-binding peptide
PTKLSPINILYF

SEQ ID NO: 3293 - protein, 20 aa, Artificial Sequence
  GFR-binding peptide
  MOD_RES (6)..(7): Xaa is C or S
KVGKAXXVPTKLSPINVLYF

SEQ ID NO: 3294 - protein, 12 aa, Artificial Sequence
  GFR-binding peptide
PTELSPINMLYF

SEQ ID NO: 3295 - protein, 14 aa, Artificial Sequence
  GFR-binding peptide
  MOD_RES (1)..(1): Xaa is C or S
XVPTKLSPINVLYF

SEQ ID NO: 3296 - protein, 18 aa, Artificial Sequence
  GFR-binding peptide
  MOD_RES (4)..(5): Xaa is C or S
PKAXXVPTELSPINMLYF

SEQ ID NO: 3297 - protein, 16 aa, Artificial Sequence
  GFR-binding peptide
  MOD_RES (2)..(3): Xaa is C or S
PXXAPTKLSPINVLYF

SEQ ID NO: 3298 - protein, 18 aa, Artificial Sequence
  GFR-binding peptide
  MOD_RES (5)..(5): Xaa is C or S
TKPTXAPTKLSPINVLYF

SEQ ID NO: 3299 - protein, 19 aa, Artificial Sequence
  GFR-binding peptide
  MOD_RES (5)..(6): Xaa is C or S
VPKAXXAPTKLSPINVLYF

SEQ ID NO: 3300 - protein, 15 aa, Artificial Sequence
  GFR-binding peptide
  MOD_RES (1)..(2): Xaa is C or S
XXVPARLSPINILYF

SEQ ID NO: 3301 - protein, 13 aa, Artificial Sequence
  GFR-binding peptide
APVKTSPINMLYF

SEQ ID NO: 3302 - protein, 12 aa, Artificial Sequence
  GFR-binding peptide
PVKTSPINMLYF

SEQ ID NO: 3303 - protein, 17 aa, Artificial Sequence
  GFR-binding peptide
  MOD_RES (3)..(4): Xaa is C or S
KPXXAPTQLSPINVLYF

SEQ ID NO: 3304 - protein, 11 aa, Artificial Sequence
  GFR-binding peptide
TQLSPINVLYF

SEQ ID NO: 3305 - protein, 14 aa, Artificial Sequence
  GFR-binding peptide
  MOD_RES (1)..(1): Xaa is C or S
XVPTELSPINMLYF

SEQ ID NO: 3306 - protein, 18 aa, Artificial Sequence
  GFR-binding peptide
  MOD_RES (4)..(5): Xaa is C or S
PSTXXAPVKTSPINMLYF

SEQ ID NO: 3307 - protein, 19 aa, Artificial Sequence
  GFR-binding peptide
  MOD_RES (5)..(6): Xaa is C or S
VPKPXXAPTQLSPINVLYF

SEQ ID NO: 3308 - protein, 16 aa, Artificial Sequence
  GFR-binding peptide
  MOD_RES (2)..(3): Xaa is C or S
AXXVPTKLSPINVLYF

SEQ ID NO: 3309 - protein, 10 aa, Artificial Sequence
  GFR-binding peptide
KTSPINMLYF

SEQ ID NO: 3310 - protein, 18 aa, Artificial Sequence
  GFR-binding peptide
  MOD_RES (4)..(5): Xaa is C or S
PPTXXVPTRLSPINILYF

SEQ ID NO: 3311 - protein, 18 aa, Artificial Sequence
  GFR-binding peptide
  MOD_RES (4)..(5): Xaa is C or S
PKPXXAPTQLSPINVLYF

SEQ ID NO: 3312 - protein, 18 aa, Artificial Sequence
  GFR-binding peptide
  MOD_RES (4)..(5): Xaa is C or S
PKPXXAPTKLSPINVLYF

SEQ ID NO: 3313 - protein, 16 aa, Artificial Sequence
  GFR-binding peptide
  MOD_RES (2)..(3): Xaa is C or S
AXXAPTKLSPINVLYF

SEQ ID NO: 3314 - protein, 18 aa, Artificial Sequence
  GFR-binding peptide
  MOD_RES (4)..(5): Xaa is C or S
SKAXXVPTKLSPINILYF

SEQ ID NO: 3315 - protein, 13 aa, Artificial Sequence
  GFR-binding peptide
VPTELSPINMLYF

SEQ ID NO: 3316 - protein, 16 aa, Artificial Sequence
  GFR-binding peptide
  MOD_RES (2)..(3): Xaa is C or S
AXXVPTKLSPINILYF

SEQ ID NO: 3317 - protein, 13 aa, Artificial Sequence
  GFR-binding peptide
VPARLSPINILYF

SEQ ID NO: 3318 - protein, 11 aa, Artificial Sequence
  GFR-binding peptide
TRLSPINILYF

SEQ ID NO: 3319 - protein, 20 aa, Artificial Sequence
  GFR-binding peptide
  MOD_RES (6)..(7): Xaa is C or S
HVPKPXXAPTKLSPINVLYF

SEQ ID NO: 3320 - protein, 15 aa, Artificial Sequence
  GFR-binding peptide
  MOD_RES (1)..(2): Xaa is C or S
XXVPTRLSPINILYF

SEQ ID NO: 3321 - protein, 9 aa, Artificial Sequence
  GFR-binding peptide
LSPINVLYF

SEQ ID NO: 3322 - protein, 16 aa, Artificial Sequence
  GFR-binding peptide
  MOD_RES (3)..(3): Xaa is C or S
PTXAPTKLSPINVLYF

SEQ ID NO: 3323 - protein, 15 aa, Artificial Sequence
  GFR-binding peptide
  MOD_RES (1)..(2): Xaa is C or S
XXVPTKLSPINVLYF

SEQ ID NO: 3324 - protein, 15 aa, Artificial Sequence
  GFR-binding peptide
  MOD_RES (1)..(2): Xaa is C or S
XXAPTKLSPINVLYF

SEQ ID NO: 3325 - protein, 12 aa, Artificial Sequence
  GFR-binding peptide
PTRLSPINILYF

SEQ ID NO: 3326 - protein, 11 aa, Artificial Sequence
  GFR-binding peptide
VKTSPINMLYF

SEQ ID NO: 3327 - protein, 17 aa, Artificial Sequence
  GFR-binding peptide
  MOD_RES (3)..(4): Xaa is C or S
KAXXVPTELSPINMLYF

SEQ ID NO: 3328 - protein, 15 aa, Artificial Sequence
  GFR-binding peptide
  MOD_RES (1)..(2): Xaa is C or S
XXVPTKLSPINILYF

SEQ ID NO: 3329 - protein, 12 aa, Artificial Sequence
  GFR-binding peptide
PTQLSPINVLYF

SEQ ID NO: 3330 - protein, 11 aa, Artificial Sequence
  GFR-binding peptide
TKLSPINILYF

SEQ ID NO: 3331 - skipped

SEQ ID NO: 3332 - protein, 12 aa, Artificial Sequence
  GFR-binding peptide
PTKLSPINVLYF

SEQ ID NO: 3333 - protein, 18 aa, Artificial Sequence
  GFR-binding peptide
  MOD_RES (4)..(5): Xaa is C or S
GKAXXVPTKLSPINVLYF

SEQ ID NO: 3334 - protein, 19 aa, Artificial Sequence
  GFR-binding peptide
  MOD_RES (5)..(6): Xaa is C or S
VPSTXXAPVKTSPINMLYF

SEQ ID NO: 3335 - protein, 15 aa, Artificial Sequence
  GFR-binding peptide
  MOD_RES (1)..(2): Xaa is C or S
XXAPTQLSPINVLYF

SEQ ID NO: 3336 - protein, 9 aa, Artificial Sequence
  GFR-binding peptide
LSPINILYF

SEQ ID NO: 3337 - protein, 17 aa, Artificial Sequence
  GFR-binding peptide
  MOD_RES (3)..(4): Xaa is C or S
STXXAPVKTSPINMLYF

SEQ ID NO: 3338 - protein, 15 aa, Artificial Sequence
  GFR-binding peptide
  MOD_RES (2)..(2): Xaa is C or S
TXAPTKLSPINVLYF

SEQ ID NO: 3339 - protein, 12 aa, Artificial Sequence
  GFR-binding peptide
PARLSPINILYF

SEQ ID NO: 3340 - protein, 16 aa, Artificial Sequence
  GFR-binding peptide
  MOD_RES (2)..(3): Xaa is C or S
PXXAPTQLSPINVLYF

SEQ ID NO: 3341 - protein, 20 aa, Artificial Sequence
  GFR-binding peptide
  MOD_RES (6)..(7): Xaa is C or S
YVPKPXXAPTKLSPINVLYF

SEQ ID NO: 3342 - protein, 10 aa, Artificial Sequence
  GFR-binding peptide
ELSPINMLYF

SEQ ID NO: 3343 - protein, 18 aa, Artificial Sequence
  GFR-binding peptide
  MOD_RES (4)..(5): Xaa is C or S
PKAXXAPTKLSPINVLYF

SEQ ID NO: 3344 - protein, 18 aa, Artificial Sequence
  GFR-binding peptide
  MOD_RES (4)..(5): Xaa is C or S
PASXXVPARLSPINILYF

SEQ ID NO: 3345 - protein, 19 aa, Artificial Sequence
  GFR-binding peptide
  MOD_RES (5)..(6): Xaa is C or S
APASXXVPARLSPINILYF

SEQ ID NO: 3346 - protein, 14 aa, Artificial Sequence
  GFR-binding peptide
  MOD_RES (1)..(1): Xaa is C or S
XAPVKTSPINMLYF

SEQ ID NO: 3347 - protein, 17 aa, Artificial Sequence
  GFR-binding peptide
  MOD_RES (3)..(4): Xaa is C or S
KAXXVPTKLSPINILYF

SEQ ID NO: 3348 - protein, 10 aa, Artificial Sequence
  GFR-binding peptide
KLSPINILYF

SEQ ID NO: 3349 - protein, 11 aa, Artificial Sequence
  GFR-binding peptide
TKLSPINVLYF

SEQ ID NO: 3350 - protein, 17 aa, Artificial Sequence
  GFR-binding peptide
  MOD_RES (3)..(4): Xaa is C or S
KPXXAPTKLSPINVLYF

SEQ ID NO: 3351 - protein, 20 aa, Artificial Sequence
  GFR-binding peptide
  MOD_RES (6)..(7): Xaa is C or S
STPPTXXVPTRLSPINILYF

SEQ ID NO: 3352 - protein, 9 aa, Artificial Sequence
  GFR-binding peptide
TSPINMLYF

SEQ ID NO: 3353 - protein, 19 aa, Artificial Sequence
  GFR-binding peptide
  MOD_RES (5)..(6): Xaa is C or S
VGKAXXVPTKLSPINVLYF

SEQ ID NO: 3354 - protein, 17 aa, Artificial Sequence
  GFR-binding peptide
  MOD_RES (3)..(4): Xaa is C or S
ASXXVPARLSPINILYF

SEQ ID NO: 3355 - protein, 14 aa, Artificial Sequence
  GFR-binding peptide
  MOD_RES (1)..(1): Xaa is C or S
XAPTKLSPINVLYF

SEQ ID NO: 3356 - protein, 20 aa, Artificial Sequence
  GFR-binding peptide
  MOD_RES (7)..(7): Xaa is C or S
HVTKPTXAPTKLSPINVLYF

SEQ ID NO: 3357 - protein, 20 aa, Artificial Sequence
  GFR-binding peptide
  MOD_RES (6)..(7): Xaa is C or S
AVPKAXXAPTKLSPINVLYF

SEQ ID NO: 3358 - protein, 14 aa, Artificial Sequence
  GFR-binding peptide
  MOD_RES (1)..(1): Xaa is C or S
XVPARLSPINILYF

SEQ ID NO: 3359 - protein, 19 aa, Artificial Sequence
  GFR-binding peptide
  MOD_RES (5)..(6): Xaa is C or S
TPPTXXVPTRLSPINILYF

SEQ ID NO: 3360 - protein, 19 aa, Artificial Sequence
  GFR-binding peptide
  MOD_RES (5)..(6): Xaa is C or S
VPKPXXAPTKLSPINVLYF

SEQ ID NO: 3361 - protein, 19 aa, Artificial Sequence
  GFR-binding peptide
  MOD_RES (5)..(6): Xaa is C or S
ASKAXXVPTKLSPINILYF

SEQ ID NO: 3362 - protein, 17 aa, Artificial Sequence
  GFR-binding peptide
  MOD_RES (3)..(4): Xaa is C or S
KAXXVPTKLSPINVLYF

SEQ ID NO: 3363 - protein, 18 aa, Artificial Sequence
  GFR-binding peptide
  MOD_RES (4)..(5): Xaa is C or S
PPTXXVPTRLNAISILYF

SEQ ID NO: 3364 - protein, 14 aa, Artificial Sequence
  GFR-binding peptide
  MOD_RES (1)..(1): Xaa is C or S
XVPQALNAISILYF

SEQ ID NO: 3365 - protein, 13 aa, Artificial Sequence
  GFR-binding peptide
VPTELNAISMLYF

SEQ ID NO: 3366 - protein, 14 aa, Artificial Sequence
  GFR-binding peptide
  MOD_RES (1)..(1): Xaa is C or S
XVSQDLNAISILYF

SEQ ID NO: 3367 - protein, 19 aa, Artificial Sequence
  GFR-binding peptide
  MOD_RES (5)..(6): Xaa is C or S
SASPXXVSQDLNAISILYF

SEQ ID NO: 3368 - protein, 14 aa, Artificial Sequence
  GFR-binding peptide
  MOD_RES (1)..(1): Xaa is C or S
XVPQDLNAISILYF

SEQ ID NO: 3369 - protein, 15 aa, Artificial Sequence
  GFR-binding peptide
  MOD_RES (1)..(2): Xaa is C or S
XXVPTRLNAISILYF

SEQ ID NO: 3370 - protein, 11 aa, Artificial Sequence
  GFR-binding peptide
QDLNAISILYF

SEQ ID NO: 3371 - protein, 13 aa, Artificial Sequence
  GFR-binding peptide
VPQDLNAISILYF

SEQ ID NO: 3372 - protein, 11 aa, Artificial Sequence
  GFR-binding peptide
TRLNAISILYF

SEQ ID NO: 3373 - protein, 19 aa, Artificial Sequence
  GFR-binding peptide
  MOD_RES (5)..(6): Xaa is C or S
SAAPXXVPQALNAISILYF

SEQ ID NO: 3374 - protein, 16 aa, Artificial Sequence
  GFR-binding peptide
  MOD_RES (2)..(3): Xaa is C or S
PXXVSQDLNAISILYF

SEQ ID NO: 3375 - protein, 17 aa, Artificial Sequence
  GFR-binding peptide
  MOD_RES (3)..(4): Xaa is C or S
SPXXVPQDLNAISILYF

SEQ ID NO: 3376 - protein, 16 aa, Artificial Sequence
  GFR-binding peptide
  MOD_RES (2)..(3): Xaa is C or S
PXXVPQALNAISILYF

SEQ ID NO: 3377 - protein, 14 aa, Artificial Sequence
  GFR-binding peptide
  MOD_RES (1)..(1): Xaa is C or S
XVPTELNAISMLYF

SEQ ID NO: 3378 - protein, 12 aa, Artificial Sequence
  GFR-binding peptide
PTELNAISMLYF

SEQ ID NO: 3379 - protein, 20 aa, Artificial Sequence
  GFR-binding peptide
  MOD_RES (6)..(7): Xaa is C or S
ASASPXXVPQDLNAISILYF

SEQ ID NO: 3380 - protein, 10 aa, Artificial Sequence
  GFR-binding peptide
DLNAISILYF

SEQ ID NO: 3381 - protein, 19 aa, Artificial Sequence
  GFR-binding peptide
  MOD_RES (5)..(6): Xaa is C or S
TPPTXXVPTRLNAISILYF

SEQ ID NO: 3382 - protein, 18 aa, Artificial Sequence
  GFR-binding peptide
  MOD_RES (4)..(5): Xaa is C or S
AAPXXVPQALNAISILYF

SEQ ID NO: 3383 - protein, 20 aa, Artificial Sequence
  GFR-binding peptide
  MOD_RES (6)..(7): Xaa is C or S
ASAAPXXVPQALNAISILYF

SEQ ID NO: 3384 - protein, 10 aa, Artificial Sequence
  GFR-binding peptide
ELNAISMLYF

SEQ ID NO: 3385 - protein, 15 aa, Artificial Sequence
  GFR-binding peptide
  MOD_RES (1)..(2): Xaa is C or S
XXVSQDLNAISILYF

SEQ ID NO: 3386 - protein, 18 aa, Artificial Sequence
  GFR-binding peptide
  MOD_RES (4)..(5): Xaa is C or S
ASPXXVSQDLNAISILYF

SEQ ID NO: 3387 - protein, 15 aa, Artificial Sequence
  GFR-binding peptide
  MOD_RES (1)..(2): Xaa is C or S
XXVPQDLNAISILYF

SEQ ID NO: 3388 - protein, 14 aa, Artificial Sequence
  GFR-binding peptide
  MOD_RES (1)..(1): Xaa is C or S
XVPTRLNAISILYF

SEQ ID NO: 3389 - protein, 18 aa, Artificial Sequence
  GFR-binding peptide
  MOD_RES (4)..(5): Xaa is C or S
PKAXXVPTELNAISMLYF

SEQ ID NO: 3390 - protein, 12 aa, Artificial Sequence
  GFR-binding peptide
PQALNAISILYF

SEQ ID NO: 3391 - protein, 16 aa, Artificial Sequence
  GFR-binding peptide
  MOD_RES (2)..(3): Xaa is C or S
TXXVPTRLNAISILYF

SEQ ID NO: 3392 - protein, 20 aa, Artificial Sequence
  GFR-binding peptide
  MOD_RES (6)..(7): Xaa is C or S
STPPTXXVPTRLNAISILYF

SEQ ID NO: 3393 - protein, 20 aa, Artificial Sequence
  GFR-binding peptide
  MOD_RES (6)..(7): Xaa is C or S
KIPKAXXVPTELNAISMLYF

SEQ ID NO: 3394 - protein, 12 aa, Artificial Sequence
  GFR-binding peptide
PQDLNAISILYF

SEQ ID NO: 3395 - protein, 11 aa, Artificial Sequence
  GFR-binding peptide
QALNAISILYF

SEQ ID NO: 3396 - protein, 20 aa, Artificial Sequence
  GFR-binding peptide
  MOD_RES (6)..(7): Xaa is C or S
ASASPXXVSQDLNAISILYF

SEQ ID NO: 3397 - protein, 13 aa, Artificial Sequence
  GFR-binding peptide
VPTRLNAISILYF

SEQ ID NO: 3398 - protein, 19 aa, Artificial Sequence
  GFR-binding peptide
  MOD_RES (5)..(6): Xaa is C or S
IPKAXXVPTELNAISMLYF

SEQ ID NO: 3399 - protein, 17 aa, Artificial Sequence
  GFR-binding peptide
  MOD_RES (3)..(4): Xaa is C or S
PTXXVPTRLNAISILYF

SEQ ID NO: 3400 - protein, 10 aa, Artificial Sequence
  GFR-binding peptide
RLNAISILYF

SEQ ID NO: 3401 - protein, 13 aa, Artificial Sequence
  GFR-binding peptide
VSQDLNAISILYF

SEQ ID NO: 3402 - protein, 12 aa, Artificial Sequence
  GFR-binding peptide
SQDLNAISILYF

SEQ ID NO: 3403 - protein, 19 aa, Artificial Sequence
  GFR-binding peptide
  MOD_RES (5)..(6): Xaa is C or S
SASPXXVPQDLNAISILYF

SEQ ID NO: 3404 - protein, 17 aa, Artificial Sequence
  GFR-binding peptide
  MOD_RES (3)..(4): Xaa is C or S
KAXXVPTELNAISMLYF

SEQ ID NO: 3405 - protein, 15 aa, Artificial Sequence
  GFR-binding peptide
  MOD_RES (1)..(2): Xaa is C or S
XXVPTELNAISMLYF

SEQ ID NO: 3406 - protein, 20 aa, Artificial Sequence
  GFR-binding peptide
  MOD_RES (6)..(7): Xaa is C or S
SIPKAXXVPTELNAISMLYF

SEQ ID NO: 3407 - protein, 12 aa, Artificial Sequence
  GFR-binding peptide
PTRLNAISILYF

SEQ ID NO: 3408 - protein, 17 aa, Artificial Sequence
  GFR-binding peptide
  MOD_RES (3)..(4): Xaa is C or S
APXXVPQALNAISILYF

SEQ ID NO: 3409 - protein, 18 aa, Artificial Sequence
  GFR-binding peptide
  MOD_RES (4)..(5): Xaa is C or S
ASPXXVPQDLNAISILYF

SEQ ID NO: 3410 - protein, 10 aa, Artificial Sequence
  GFR-binding peptide
ALNAISILYF

SEQ ID NO: 3411 - protein, 16 aa, Artificial Sequence
  GFR-binding peptide
  MOD_RES (2)..(3): Xaa is C or S
AXXVPTELNAISMLYF

SEQ ID NO: 3412 - protein, 11 aa, Artificial Sequence
  GFR-binding peptide
TELNAISMLYF

SEQ ID NO: 3413 - protein, 15 aa, Artificial Sequence
  GFR-binding peptide
  MOD_RES (1)..(2): Xaa is C or S
XXVPQALNAISILYF

SEQ ID NO: 3414 - protein, 9 aa, Artificial Sequence
  GFR-binding peptide
LNAISMLYF

SEQ ID NO: 3415 - protein, 17 aa, Artificial Sequence
  GFR-binding peptide
  MOD_RES (3)..(4): Xaa is C or S
SPXXVSQDLNAISILYF

SEQ ID NO: 3416 - protein, 13 aa, Artificial Sequence
  GFR-binding peptide
VPQALNAISILYF

SEQ ID NO: 3417 - protein, 16 aa, Artificial Sequence
  GFR-binding peptide
  MOD_RES (2)..(3): Xaa is C or S
PXXVPQDLNAISILYF

SEQ ID NO: 3418 - protein, 9 aa, Artificial Sequence
  GFR-binding peptide
LNAISILYF

SEQ ID NO: 3419 - protein, 13 aa, Artificial Sequence
  GFR-binding peptide
APTKLSPISVLFI

SEQ ID NO: 3420 - protein, 12 aa, Artificial Sequence
  GFR-binding peptide
PTKLSPISILYI

SEQ ID NO: 3421 - protein, 14 aa, Artificial Sequence
  GFR-binding peptide
  MOD_RES (1)..(1): Xaa is C or S
XVPQALSPISILFI

SEQ ID NO: 3422 - protein, 10 aa, Artificial Sequence
  GFR-binding peptide
ELSPISMLYI

SEQ ID NO: 3423 - protein, 20 aa, Artificial Sequence
  GFR-binding peptide
  MOD_RES (7)..(7): Xaa is C or S
HVTKPTXAPTKLSPISVLFI

SEQ ID NO: 3424 - protein, 11 aa, Artificial Sequence
  GFR-binding peptide
TELSPISMLFI

SEQ ID NO: 3425 - protein, 11 aa, Artificial Sequence
  GFR-binding peptide
TQLEPLTVLYY

SEQ ID NO: 3426 - protein, 13 aa, Artificial Sequence
  GFR-binding peptide
VPQDLEPLPIVYY

SEQ ID NO: 3427 - protein, 12 aa, Artificial Sequence
  GFR-binding peptide
PTQLEPLPVVYY

SEQ ID NO: 3428 - protein, 19 aa, Artificial Sequence
  GFR-binding peptide
  MOD_RES (5)..(6): Xaa is C or S
VPKPXXAPTKLEPLTVLYY

SEQ ID NO: 3429 - protein, 14 aa, Artificial Sequence
  GFR-binding peptide
  MOD_RES (1)..(1): Xaa is C or S
XVPTRLSPISILYI

SEQ ID NO: 3430 - protein, 15 aa, Artificial Sequence
  GFR-binding peptide
  MOD_RES (1)..(2): Xaa is C or S
XXAPTKLSPISVLYI

SEQ ID NO: 3431 - protein, 17 aa, Artificial Sequence
  GFR-binding peptide
  MOD_RES (3)..(4): Xaa is C or S
KPXXAPTQLEPLTVLYY

SEQ ID NO: 3432 - protein, 16 aa, Artificial Sequence
  GFR-binding peptide
  MOD_RES (2)..(3): Xaa is C or S
PXXAPTKLSPISVLYI

SEQ ID NO: 3433 - protein, 18 aa, Artificial Sequence
  GFR-binding peptide
  MOD_RES (5)..(5): Xaa is C or S
TKPTXAPTKLEPLTVLYY

SEQ ID NO: 3434 - protein, 18 aa, Artificial Sequence
  GFR-binding peptide
  MOD_RES (4)..(5): Xaa is C or S
PKPXXAPTKLEPLTVLYY

SEQ ID NO: 3435 - protein, 16 aa, Artificial Sequence
  GFR-binding peptide
  MOD_RES (2)..(3): Xaa is C or S
PXXAPTKLEPLPVVYY

SEQ ID NO: 3436 - protein, 16 aa, Artificial Sequence
  GFR-binding peptide
  MOD_RES (3)..(3): Xaa is C or S
PTXAPTKLEPLTVLYY

SEQ ID NO: 3437 - protein, 18 aa, Artificial Sequence
  GFR-binding peptide
  MOD_RES (4)..(5): Xaa is C or S
PKAXXVPTELEPLPMVYY

SEQ ID NO: 3438 - protein, 19 aa, Artificial Sequence
  GFR-binding peptide
  MOD_RES (5)..(6): Xaa is C or S
IPKAXXVPTELSPISMLYI

SEQ ID NO: 3439 - protein, 19 aa, Artificial Sequence
  GFR-binding peptide
  MOD_RES (5)..(6): Xaa is C or S
SASPXXVPQDLSPISILFI

SEQ ID NO: 3440 - protein, 18 aa, Artificial Sequence
  GFR-binding peptide
  MOD_RES (4)..(5): Xaa is C or S
ASPXXVSQDLEPLPIVYY

SEQ ID NO: 3441 - protein, 20 aa, Artificial Sequence
  GFR-binding peptide
  MOD_RES (6)..(7): Xaa is C or S
GSAGPXXTPTKMSPISMLYI

SEQ ID NO: 3442 - protein, 9 aa, Artificial Sequence
  GFR-binding peptide
LEPLPVVYY

SEQ ID NO: 3443 - protein, 20 aa, Artificial Sequence
  GFR-binding peptide
  MOD_RES (6)..(7): Xaa is C or S
YVPKPXXAPTKLSPISVLFI

SEQ ID NO: 3444 - protein, 16 aa, Artificial Sequence
  GFR-binding peptide
  MOD_RES (2)..(3): Xaa is C or S
AXXVPTELSPISMLFI

SEQ ID NO: 3445 - protein, 11 aa, Artificial Sequence
  GFR-binding peptide
TKMSPISMLYI

SEQ ID NO: 3446 - protein, 20 aa, Artificial Sequence
  GFR-binding peptide
  MOD_RES (6)..(7): Xaa is C or S
SIPKAXXVPTELSPISMLFI

SEQ ID NO: 3447 - protein, 14 aa, Artificial Sequence
  GFR-binding peptide
  MOD_RES (1)..(1): Xaa is C or S
XAPTQLSPISVLYI

SEQ ID NO: 3448 - protein, 15 aa, Artificial Sequence
  GFR-binding peptide
  MOD_RES (1)..(2): Xaa is C or S
XXAPVKTSPISMLYI

SEQ ID NO: 3449 - protein, 10 aa, Artificial Sequence
  GFR-binding peptide
DLEPLPIVYY

SEQ ID NO: 3450 - protein, 13 aa, Artificial Sequence
  GFR-binding peptide
VPTELEPLTMLYY

SEQ ID NO: 3451 - protein, 11 aa, Artificial Sequence
  GFR-binding peptide
TRLEPLPIVYY

SEQ ID NO: 3452 - protein, 10 aa, Artificial Sequence
  GFR-binding peptide
KLSPISVLFI

SEQ ID NO: 3453 - protein, 19 aa, Artificial Sequence
  GFR-binding peptide
  MOD_RES (5)..(6): Xaa is C or S
VPKPXXAPTKLEPLPVVYY

SEQ ID NO: 3454 - protein, 15 aa, Artificial Sequence
  GFR-binding peptide
  MOD_RES (1)..(2): Xaa is C or S
XXVPTELEPLTMLYY

SEQ ID NO: 3455 - protein, 9 aa, Artificial Sequence
  GFR-binding peptide
LSPISMLFI

SEQ ID NO: 3456 - protein, 14 aa, Artificial Sequence
  GFR-binding peptide
  MOD_RES (1)..(1): Xaa is C or S
XVPTKLSPISILYI

SEQ ID NO: 3457 - protein, 18 aa, Artificial Sequence
  GFR-binding peptide
  MOD_RES (4)..(5): Xaa is C or S
PKAXXVPTELSPISMLYI

SEQ ID NO: 3458 - protein, 16 aa, Artificial Sequence
  GFR-binding peptide
  MOD_RES (2)..(3): Xaa is C or S
AXXVPTELSPISMLYI

SEQ ID NO: 3459 - protein, 15 aa, Artificial Sequence
  GFR-binding peptide
  MOD_RES (1)..(2): Xaa is C or S
XXVSQDLSPISILFI

SEQ ID NO: 3460 - protein, 15 aa, Artificial Sequence
  GFR-binding peptide
  MOD_RES (1)..(2): Xaa is C or S
XXVPTKLSPISVLYI

SEQ ID NO: 3461 - protein, 16 aa, Artificial Sequence
  GFR-binding peptide
  MOD_RES (2)..(3): Xaa is C or S
PXXVPQDLEPLPIVYY

SEQ ID NO: 3462 - protein, 11 aa, Artificial Sequence
  GFR-binding peptide
TQLEPLPVVYY

SEQ ID NO: 3463 - protein, 10 aa, Artificial Sequence
  GFR-binding peptide
ELSPISMLFI

SEQ ID NO: 3464 - protein, 13 aa, Artificial Sequence
  GFR-binding peptide
VPQALEPLTILYY

SEQ ID NO: 3465 - protein, 17 aa, Artificial Sequence
  GFR-binding peptide
  MOD_RES (4)..(4): Xaa is C or S
KPTXAPTKLSPISVLFI

SEQ ID NO: 3466 - protein, 17 aa, Artificial Sequence
  GFR-binding peptide
  MOD_RES (3)..(4): Xaa is C or S
KPXXAPTQLEPLPVVYY

SEQ ID NO: 3467 - protein, 10 aa, Artificial Sequence
  GFR-binding peptide
KMSPISMLYI

SEQ ID NO: 3468 - protein, 17 aa, Artificial Sequence
  GFR-binding peptide
  MOD_RES (3)..(4): Xaa is C or S
PTXXVPTRLEPLPIVYY

SEQ ID NO: 3469 - protein, 14 aa, Artificial Sequence
  GFR-binding peptide
  MOD_RES (1)..(1): Xaa is C or S
XAPTQLEPLPVVYY

SEQ ID NO: 3470 - protein, 13 aa, Artificial Sequence
  GFR-binding peptide
APTQLEPLTVLYY

SEQ ID NO: 3471 - protein, 17 aa, Artificial Sequence
  GFR-binding peptide
  MOD_RES (4)..(4): Xaa is C or S
KPTXAPTKLEPLPVVYY

SEQ ID NO: 3472 - protein, 19 aa, Artificial Sequence
  GFR-binding peptide
  MOD_RES (5)..(6): Xaa is C or S
IPKAXXVPTELSPISMLFI

SEQ ID NO: 3473 - protein, 18 aa, Artificial Sequence
  GFR-binding peptide
  MOD_RES (4)..(5): Xaa is C or S
PPTXXVPTRLEPLTILYY

SEQ ID NO: 3474 - protein, 13 aa, Artificial Sequence
  GFR-binding peptide
VPTELSPISMLYI

SEQ ID NO: 3475 - protein, 10 aa, Artificial Sequence
  GFR-binding peptide
RLEPLTILYY

SEQ ID NO: 3476 - protein, 12 aa, Artificial Sequence
  GFR-binding peptide
PTQLEPLTVLYY

SEQ ID NO: 3477 - protein, 18 aa, Artificial Sequence
  GFR-binding peptide
  MOD_RES (4)..(5): Xaa is C or S
PKPXXAPTKLEPLPVVYY

SEQ ID NO: 3478 - protein, 16 aa, Artificial Sequence
  GFR-binding peptide
  MOD_RES (3)..(3): Xaa is C or S
PTXAPTKLEPLPVVYY

SEQ ID NO: 3479 - protein, 17 aa, Artificial Sequence
  GFR-binding peptide
  MOD_RES (3)..(4): Xaa is C or S
SPXXVSQDLEPLPIVYY

SEQ ID NO: 3480 - protein, 16 aa, Artificial Sequence
  GFR-binding peptide
  MOD_RES (2)..(3): Xaa is C or S
PXXAPTKLEPLTVLYY

SEQ ID NO: 3481 - protein, 20 aa, Artificial Sequence
  GFR-binding peptide
  MOD_RES (6)..(7): Xaa is C or S
SIPKAXXVPTELSPISMLYI

SEQ ID NO: 3482 - protein, 11 aa, Artificial Sequence
  GFR-binding peptide
TKLSPISVLFI

SEQ ID NO: 3483 - protein, 19 aa, Artificial Sequence
  GFR-binding peptide
  MOD_RES (5)..(6): Xaa is C or S
SAAPXXVPQALSPISILFI

SEQ ID NO: 3484 - protein, 13 aa, Artificial Sequence
  GFR-binding peptide
VPTKLSPISVLYI

SEQ ID NO: 3485 - protein, 14 aa, Artificial Sequence
  GFR-binding peptide
  MOD_RES (1)..(1): Xaa is C or S
XVPTRLEPLPIVYY

SEQ ID NO: 3486 - protein, 20 aa, Artificial Sequence
  GFR-binding peptide
  MOD_RES (6)..(7): Xaa is C or S
KIPKAXXVPTELEPLTMLYY

SEQ ID NO: 3487 - protein, 19 aa, Artificial Sequence
  GFR-binding peptide
  MOD_RES (5)..(6): Xaa is C or S
VPKAXXAPTKLSPISVLYI

SEQ ID NO: 3488 - protein, 13 aa, Artificial Sequence
  GFR-binding peptide
VPTRLEPLTILYY

SEQ ID NO: 3489 - protein, 11 aa, Artificial Sequence
  GFR-binding peptide
TELEPLPMVYY

SEQ ID NO: 3490 - protein, 17 aa, Artificial Sequence
  GFR-binding peptide
  MOD_RES (3)..(4): Xaa is C or S
KPXXAPTKLSPISVLFI

SEQ ID NO: 3491 - protein, 12 aa, Artificial Sequence
  GFR-binding peptide
PTQLSPISVLYI

SEQ ID NO: 3492 - protein, 15 aa, Artificial Sequence
  GFR-binding peptide
  MOD_RES (1)..(2): Xaa is C or S
XXAPTKLEPLPVVYY

SEQ ID NO: 3493 - protein, 16 aa, Artificial Sequence
  GFR-binding peptide
  MOD_RES (2)..(3): Xaa is C or S
AXXVPTKLSPISILYI

SEQ ID NO: 3494 - protein, 12 aa, Artificial Sequence
  GFR-binding peptide
PTRLEPLPIVYY

SEQ ID NO: 3495 - protein, 10 aa, Artificial Sequence
  GFR-binding peptide
KLSPISVLYI

SEQ ID NO: 3496 - protein, 13 aa, Artificial Sequence
  GFR-binding peptide
VPQDLSPISILFI

SEQ ID NO: 3497 - protein, 15 aa, Artificial Sequence
  GFR-binding peptide
  MOD_RES (2)..(2): Xaa is C or S
TXAPTKLSPISVLFI

SEQ ID NO: 3498 - protein, 13 aa, Artificial Sequence
  GFR-binding peptide
APTKLEPLPVVYY

SEQ ID NO: 3499 - protein, 13 aa, Artificial Sequence
  GFR-binding peptide
VPTELSPISMLFI

SEQ ID NO: 3500 - protein, 16 aa, Artificial Sequence
  GFR-binding peptide
  MOD_RES (2)..(3): Xaa is C or S
PXXVPQALEPLTILYY

SEQ ID NO: 3501 - protein, 10 aa, Artificial Sequence
  GFR-binding peptide
RLEPLPIVYY

SEQ ID NO: 3502 - protein, 20 aa, Artificial Sequence
  GFR-binding peptide
  MOD_RES (6)..(7): Xaa is C or S
YVPKPXXAPTKLSPISVLYI

SEQ ID NO: 3503 - protein, 20 aa, Artificial Sequence
  GFR-binding peptide
  MOD_RES (6)..(7): Xaa is C or S
SIPKAXXVPTELEPLPMVYY

SEQ ID NO: 3504 - protein, 16 aa, Artificial Sequence
  GFR-binding peptide
  MOD_RES (2)..(3): Xaa is C or S
TXXVPTRLEPLTILYY

SEQ ID NO: 3505 - protein, 14 aa, Artificial Sequence
  GFR-binding peptide
  MOD_RES (1)..(1): Xaa is C or S
XVPTRLEPLTILYY

SEQ ID NO: 3506 - protein, 13 aa, Artificial Sequence
  GFR-binding peptide
TPTKMSPISMLYI

SEQ ID NO: 3507 - protein, 14 aa, Artificial Sequence
  GFR-binding peptide
  MOD_RES (1)..(1): Xaa is C or S
XAPTKLEPLTVLYY

SEQ ID NO: 3508 - protein, 16 aa, Artificial Sequence
  GFR-binding peptide
  MOD_RES (3)..(3): Xaa is C or S
PTXAPTKLSPISVLFI

SEQ ID NO: 3509 - protein, 17 aa, Artificial Sequence
  GFR-binding peptide
  MOD_RES (4)..(4): Xaa is C or S
KPTXAPTKLEPLTVLYY

SEQ ID NO: 3510 - protein, 14 aa, Artificial Sequence
  GFR-binding peptide
  MOD_RES (1)..(1): Xaa is C or S
XVSQDLSPISILFI

SEQ ID NO: 3511 - protein, 11 aa, Artificial Sequence
  GFR-binding peptide
QDLEPLPIVYY

SEQ ID NO: 3512 - protein, 19 aa, Artificial Sequence
  GFR-binding peptide
  MOD_RES (6)..(6): Xaa is C or S
VTKPTXAPTKLEPLTVLYY

SEQ ID NO: 3513 - protein, 17 aa, Artificial Sequence
  GFR-binding peptide
  MOD_RES (3)..(4): Xaa is C or S
GPXXTPTKMSPISMLYI

SEQ ID NO: 3514 - protein, 9 aa, Artificial Sequence
  GFR-binding peptide
LSPISVLFI

SEQ ID NO: 3515 - protein, 14 aa, Artificial Sequence
  GFR-binding peptide
  MOD_RES (1)..(1): Xaa is C or S
XAPVKTSPISMLYI

SEQ ID NO: 3516 - protein, 15 aa, Artificial Sequence
  GFR-binding peptide
  MOD_RES (2)..(2): Xaa is C or S
TXAPTKLEPLPVVYY

SEQ ID NO: 3517 - protein, 16 aa, Artificial Sequence
  GFR-binding peptide
  MOD_RES (2)..(3): Xaa is C or S
AXXVPTELEPLTMLYY

SEQ ID NO: 3518 - protein, 11 aa, Artificial Sequence
  GFR-binding peptide
QALSPISILFI

SEQ ID NO: 3519 - protein, 11 aa, Artificial Sequence
  GFR-binding peptide
TQLSPISVLYI

SEQ ID NO: 3520 - protein, 18 aa, Artificial Sequence
  GFR-binding peptide
  MOD_RES (4)..(5): Xaa is C or S
PKAXXVPTELEPLTMLYY

SEQ ID NO: 3521 - protein, 14 aa, Artificial Sequence
  GFR-binding peptide
  MOD_RES (1)..(1): Xaa is C or S
XAPTQLEPLTVLYY

SEQ ID NO: 3522 - protein, 15 aa, Artificial Sequence
  GFR-binding peptide
  MOD_RES (1)..(2): Xaa is C or S
XXVPQDLEPLPIVYY

SEQ ID NO: 3523 - protein, 17 aa, Artificial Sequence
  GFR-binding peptide
  MOD_RES (3)..(4): Xaa is C or S
KAXXVPTELSPISMLFI

SEQ ID NO: 3524 - protein, 10 aa, Artificial Sequence
  GFR-binding peptide
ELEPLTMLYY

SEQ ID NO: 3525 - protein, 19 aa, Artificial Sequence
  GFR-binding peptide
  MOD_RES (5)..(6): Xaa is C or S
ASKAXXVPTKLSPISILYI

SEQ ID NO: 3526 - protein, 13 aa, Artificial Sequence
  GFR-binding peptide
VSQDLSPISILFI

SEQ ID NO: 3527 - protein, 19 aa, Artificial Sequence
  GFR-binding peptide
  MOD_RES (5)..(6): Xaa is C or S
TPPTXXVPTRLSPISILYI

SEQ ID NO: 3528 - protein, 18 aa, Artificial Sequence
  GFR-binding peptide
  MOD_RES (4)..(5): Xaa is C or S
ASPXXVPQDLSPISILFI

SEQ ID NO: 3529 - protein, 17 aa, Artificial Sequence
  GFR-binding peptide
  MOD_RES (3)..(4): Xaa is C or S
APXXVPQALSPISILFI

SEQ ID NO: 3530 - protein, 20 aa, Artificial Sequence
  GFR-binding peptide
  MOD_RES (7)..(7): Xaa is C or S
HVTKPTXAPTKLEPLPVVYY

SEQ ID NO: 3531 - protein, 19 aa, Artificial Sequence
  GFR-binding peptide
  MOD_RES (5)..(6): Xaa is C or S
IPKAXXVPTELEPLTMLYY

SEQ ID NO: 3532 - protein, 15 aa, Artificial Sequence
  GFR-binding peptide
  MOD_RES (1)..(2): Xaa is C or S
XXVPQALSPISILFI

SEQ ID NO: 3533 - protein, 19 aa, Artificial Sequence
  GFR-binding peptide
  MOD_RES (5)..(6): Xaa is C or S
VPKPXXAPTQLSPISVLYI

SEQ ID NO: 3534 - protein, 16 aa, Artificial Sequence
  GFR-binding peptide
  MOD_RES (2)..(3): Xaa is C or S
PXXVPQDLSPISILFI

SEQ ID NO: 3535 - protein, 17 aa, Artificial Sequence
  GFR-binding peptide
  MOD_RES (3)..(4): Xaa is C or S
KAXXVPTELEPLTMLYY

SEQ ID NO: 3536 - protein, 17 aa, Artificial Sequence
  GFR-binding peptide
  MOD_RES (3)..(4): Xaa is C or S
KPXXAPTKLEPLPVVYY

SEQ ID NO: 3537 - protein, 16 aa, Artificial Sequence
  GFR-binding peptide
  MOD_RES (2)..(3): Xaa is C or S
AXXAPTKLSPISVLYI

SEQ ID NO: 3538 - protein, 12 aa, Artificial Sequence
  GFR-binding peptide
SQDLEPLPIVYY

SEQ ID NO: 3539 - protein, 9 aa, Artificial Sequence
  GFR-binding peptide
LSPISVLYI

SEQ ID NO: 3540 - protein, 16 aa, Artificial Sequence
  GFR-binding peptide
  MOD_RES (2)..(3): Xaa is C or S
PXXAPTKLSPISVLFI

SEQ ID NO: 3541 - protein, 19 aa, Artificial Sequence
  GFR-binding peptide
  MOD_RES (5)..(6): Xaa is C or S
VPKPXXAPTKLSPISVLYI

SEQ ID NO: 3542 - protein, 17 aa, Artificial Sequence
  GFR-binding peptide
  MOD_RES (3)..(4): Xaa is C or S
KAXXVPTKLSPISVLYI

SEQ ID NO: 3543 - protein, 16 aa, Artificial Sequence
  GFR-binding peptide
  MOD_RES (3)..(3): Xaa is C or S
PTXAPTKLSPISVLYI

SEQ ID NO: 3544 - protein, 17 aa, Artificial Sequence
  GFR-binding peptide
  MOD_RES (3)..(4): Xaa is C or S
APXXVPQALEPLTILYY

SEQ ID NO: 3545 - protein, 10 aa, Artificial Sequence
  GFR-binding peptide
QLEPLTVLYY

SEQ ID NO: 3546 - protein, 12 aa, Artificial Sequence
  GFR-binding peptide
PTRLEPLTILYY

SEQ ID NO: 3547 - protein, 20 aa, Artificial Sequence
  GFR-binding peptide
  MOD_RES (6)..(7): Xaa is C or S
HVPKPXXAPTKLSPISVLYI

SEQ ID NO: 3548 - protein, 9 aa, Artificial Sequence
  GFR-binding peptide
MSPISMLYI

SEQ ID NO: 3549 - protein, 11 aa, Artificial Sequence
  GFR-binding peptide
TELEPLTMLYY

SEQ ID NO: 3550 - protein, 11 aa, Artificial Sequence
  GFR-binding peptide
TELSPISMLYI

SEQ ID NO: 3551 - protein, 19 aa, Artificial Sequence
  GFR-binding peptide
  MOD_RES (5)..(6): Xaa is C or S
SASPXXVPQDLEPLPIVYY

SEQ ID NO: 3552 - protein, 19 aa, Artificial Sequence
  GFR-binding peptide
  MOD_RES (5)..(6): Xaa is C or S
TPPTXXVPTRLEPLTILYY

SEQ ID NO: 3553 - protein, 11 aa, Artificial Sequence
  GFR-binding peptide
QALEPLTILYY

SEQ ID NO: 3554 - protein, 11 aa, Artificial Sequence
  GFR-binding peptide
TKLSPISVLYI

SEQ ID NO: 3555 - protein, 17 aa, Artificial Sequence
  GFR-binding peptide
  MOD_RES (3)..(4): Xaa is C or S
KAXXVPTELSPISMLYI

SEQ ID NO: 3556 - protein, 10 aa, Artificial Sequence
  GFR-binding peptide
QLSPISVLYI

SEQ ID NO: 3557 - protein, 14 aa, Artificial Sequence
  GFR-binding peptide
  MOD_RES (1)..(1): Xaa is C or S
XAPTQLSPISVLFI

SEQ ID NO: 3558 - protein, 12 aa, Artificial Sequence
  GFR-binding peptide
PTRLSPISILYI

SEQ ID NO: 3559 - protein, 19 aa, Artificial Sequence
  GFR-binding peptide
  MOD_RES (5)..(6): Xaa is C or S
VPKPXXAPTQLSPISVLFI

SEQ ID NO: 3560 - protein, 19 aa, Artificial Sequence
  GFR-binding peptide
  MOD_RES (5)..(6): Xaa is C or S
VPSTXXAPVKTSPISMLYI

SEQ ID NO: 3561 - protein, 11 aa, Artificial Sequence
  GFR-binding peptide
QDLSPISILFI

SEQ ID NO: 3562 - protein, 18 aa, Artificial Sequence
  GFR-binding peptide
  MOD_RES (4)..(5): Xaa is C or S
PKAXXVPTELSPISMLFI

SEQ ID NO: 3563 - protein, 20 aa, Artificial Sequence
  GFR-binding peptide
  MOD_RES (6)..(7): Xaa is C or S
TVPKPXXAPTQLSPISVLFI

SEQ ID NO: 3564 - protein, 9 aa, Artificial Sequence
  GFR-binding peptide
LEPLPMVYY

SEQ ID NO: 3565 - protein, 14 aa, Artificial Sequence
  GFR-binding peptide
  MOD_RES (1)..(1): Xaa is C or S
XVSQDLEPLPIVYY

SEQ ID NO: 3566 - protein, 13 aa, Artificial Sequence
  GFR-binding peptide
VPTELEPLPMVYY

SEQ ID NO: 3567 - protein, 18 aa, Artificial Sequence
  GFR-binding peptide
  MOD_RES (4)..(5): Xaa is C or S
GKAXXVPTKLSPISVLYI

SEQ ID NO: 3568 - protein, 11 aa, Artificial Sequence
  GFR-binding peptide
TQLSPISVLFI

SEQ ID NO: 3569 - protein, 18 aa, Artificial Sequence
  GFR-binding peptide
  MOD_RES (4)..(5): Xaa is C or S
AAPXXVPQALSPISILFI

SEQ ID NO: 3570 - protein, 15 aa, Artificial Sequence
  GFR-binding peptide
  MOD_RES (1)..(2): Xaa is C or S
XXVPTELEPLPMVYY

SEQ ID NO: 3571 - protein, 9 aa, Artificial Sequence
  GFR-binding peptide
LEPLTVLYY

SEQ ID NO: 3572 - protein, 17 aa, Artificial Sequence
  GFR-binding peptide
  MOD_RES (4)..(4): Xaa is C or S
KPTXAPTKLSPISVLYI

SEQ ID NO: 3573 - protein, 11 aa, Artificial Sequence
  GFR-binding peptide
VKTSPISMLYI

SEQ ID NO: 3574 - protein, 20 aa, Artificial Sequence
  GFR-binding peptide
  MOD_RES (6)..(7): Xaa is C or S
TVPKPXXAPTQLSPISVLYI

SEQ ID NO: 3575 - protein, 20 aa, Artificial Sequence
  GFR-binding peptide
  MOD_RES (6)..(7): Xaa is C or S
RVPSTXXAPVKTSPISMLYI

SEQ ID NO: 3576 - protein, 13 aa, Artificial Sequence
  GFR-binding peptide
APTQLSPISVLFI

SEQ ID NO: 3577 - protein, 17 aa, Artificial Sequence
  GFR-binding peptide
  MOD_RES (3)..(4): Xaa is C or S
KAXXVPTELEPLPMVYY

SEQ ID NO: 3578 - protein, 11 aa, Artificial Sequence
  GFR-binding peptide
TKLEPLTVLYY

SEQ ID NO: 3579 - protein, 14 aa, Artificial Sequence
  GFR-binding peptide
  MOD_RES (1)..(1): Xaa is C or S
XVPTKLSPISVLYI

SEQ ID NO: 3580 - protein, 15 aa, Artificial Sequence
  GFR-binding peptide
  MOD_RES (1)..(2): Xaa is C or S
XXAPTQLEPLPVVYY

SEQ ID NO: 3581 - protein, 18 aa, Artificial Sequence
  GFR-binding peptide
  MOD_RES (4)..(5): Xaa is C or S
PSTXXAPVKTSPISMLYI

SEQ ID NO: 3582 - protein, 17 aa, Artificial Sequence
  GFR-binding peptide
  MOD_RES (3)..(4): Xaa is C or S
KPXXAPTKLEPLTVLYY

SEQ ID NO: 3583 - protein, 16 aa, Artificial Sequence
  GFR-binding peptide
  MOD_RES (2)..(3): Xaa is C or S
PXXAPTQLSPISVLYI

SEQ ID NO: 3584 - protein, 13 aa, Artificial Sequence
  GFR-binding peptide
VSQDLEPLPIVYY

SEQ ID NO: 3585 - protein, 15 aa, Artificial Sequence
  GFR-binding peptide
  MOD_RES (1)..(2): Xaa is C or S
XXVPTKLSPISILYI

SEQ ID NO: 3586 - protein, 20 aa, Artificial Sequence
  GFR-binding peptide
  MOD_RES (6)..(7): Xaa is C or S
ASAAPXXVPQALEPLTILYY

SEQ ID NO: 3587 - protein, 19 aa, Artificial Sequence
  GFR-binding peptide
  MOD_RES (5)..(6): Xaa is C or S
SASPXXVSQDLSPISILFI

SEQ ID NO: 3588 - protein, 10 aa, Artificial Sequence
  GFR-binding peptide
QLSPISVLFI

SEQ ID NO: 3589 - protein, 14 aa, Artificial Sequence
  GFR-binding peptide
  MOD_RES (1)..(1): Xaa is C or S
XVPQDLEPLPIVYY

SEQ ID NO: 3590 - protein, 19 aa, Artificial Sequence
  GFR-binding peptide
  MOD_RES (5)..(6): Xaa is C or S
VPKPXXAPTQLEPLTVLYY

SEQ ID NO: 3591 - protein, 14 aa, Artificial Sequence
  GFR-binding peptide
  MOD_RES (1)..(1): Xaa is C or S
XVPTELEPLTMLYY

SEQ ID NO: 3592 - protein, 18 aa, Artificial Sequence
  GFR-binding peptide
  MOD_RES (4)..(5): Xaa is C or S
PKPXXAPTQLEPLTVLYY

SEQ ID NO: 3593 - protein, 15 aa, Artificial Sequence
  GFR-binding peptide
  MOD_RES (1)..(2): Xaa is C or S
XXVPTELSPISMLFI

SEQ ID NO: 3594 - protein, 20 aa, Artificial Sequence
  GFR-binding peptide
  MOD_RES (6)..(7): Xaa is C or S
TVPKPXXAPTQLEPLPVVYY

SEQ ID NO: 3595 - protein, 20 aa, Artificial Sequence
  GFR-binding peptide
  MOD_RES (6)..(7): Xaa is C or S
AVPKAXXAPTKLSPISVLYI

SEQ ID NO: 3596 - protein, 16 aa, Artificial Sequence
  GFR-binding peptide
  MOD_RES (2)..(3): Xaa is C or S
PXXAPTQLEPLPVVYY

SEQ ID NO: 3597 - protein, 10 aa, Artificial Sequence
  GFR-binding peptide
ALSPISILFI

SEQ ID NO: 3598 - protein, 15 aa, Artificial Sequence
  GFR-binding peptide
  MOD_RES (1)..(2): Xaa is C or S
XXVPTRLEPLPIVYY

SEQ ID NO: 3599 - protein, 10 aa, Artificial Sequence
  GFR-binding peptide
KTSPISMLYI

SEQ ID NO: 3600 - protein, 20 aa, Artificial Sequence
  GFR-binding peptide
  MOD_RES (6)..(7): Xaa is C or S
YVPKPXXAPTKLEPLTVLYY

SEQ ID NO: 3601 - protein, 14 aa, Artificial Sequence
  GFR-binding peptide
  MOD_RES (1)..(1): Xaa is C or S
XVPTELEPLPMVYY

SEQ ID NO: 3602 - protein, 12 aa, Artificial Sequence
  GFR-binding peptide
PVKTSPISMLYI

SEQ ID NO: 3603 - protein, 15 aa, Artificial Sequence
  GFR-binding peptide
  MOD_RES (1)..(2): Xaa is C or S
XXTPTKMSPISMLYI

SEQ ID NO: 3604 - protein, 17 aa, Artificial Sequence
  GFR-binding peptide
  MOD_RES (3)..(4): Xaa is C or S
SPXXVPQDLEPLPIVYY

SEQ ID NO: 3605 - protein, 13 aa, Artificial Sequence
  GFR-binding peptide
VPQALSPISILFI

SEQ ID NO: 3606 - protein, 14 aa, Artificial Sequence
  GFR-binding peptide
  MOD_RES (1)..(1): Xaa is C or S
XAPTKLSPISVLYI

SEQ ID NO: 3607 - protein, 18 aa, Artificial Sequence
  GFR-binding peptide
  MOD_RES (4)..(5): Xaa is C or S
PKPXXAPTQLSPISVLYI

SEQ ID NO: 3608 - protein, 16 aa, Artificial Sequence
  GFR-binding peptide
  MOD_RES (2)..(3): Xaa is C or S
PXXVSQDLEPLPIVYY

SEQ ID NO: 3609 - protein, 16 aa, Artificial Sequence
  GFR-binding peptide
  MOD_RES (2)..(3): Xaa is C or S
PXXTPTKMSPISMLYI

SEQ ID NO: 3610 - protein, 18 aa, Artificial Sequence
  GFR-binding peptide
  MOD_RES (4)..(5): Xaa is C or S
AAPXXVPQALEPLTILYY

SEQ ID NO: 3611 - protein, 11 aa, Artificial Sequence
  GFR-binding peptide
TKLEPLPVVYY

SEQ ID NO: 3612 - protein, 20 aa, Artificial Sequence
  GFR-binding peptide
  MOD_RES (6)..(7): Xaa is C or S
SIPKAXXVPTELEPLTMLYY

SEQ ID NO: 3613 - protein, 18 aa, Artificial Sequence
  GFR-binding peptide
  MOD_RES (4)..(5): Xaa is C or S
PPTXXVPTRLSPISILYI

SEQ ID NO: 3614 - protein, 13 aa, Artificial Sequence
  GFR-binding peptide
APTQLSPISVLYI

SEQ ID NO: 3615 - protein, 15 aa, Artificial Sequence
  GFR-binding peptide
  MOD_RES (1)..(2): Xaa is C or S
XXVPTRLSPISILYI

SEQ ID NO: 3616 - protein, 12 aa, Artificial Sequence
  GFR-binding peptide
SQDLSPISILFI

SEQ ID NO: 3617 - protein, 13 aa, Artificial Sequence
  GFR-binding peptide
VPTKLSPISILYI

SEQ ID NO: 3618 - protein, 19 aa, Artificial Sequence
  GFR-binding peptide
  MOD_RES (5)..(6): Xaa is C or S
VPKPXXAPTQLEPLPVVYY

SEQ ID NO: 3619 - protein, 9 aa, Artificial Sequence
  GFR-binding peptide
LEPLTMLYY

SEQ ID NO: 3620 - protein, 10 aa, Artificial Sequence
  GFR-binding peptide
KLEPLTVLYY

SEQ ID NO: 3621 - protein, 15 aa, Artificial Sequence
  GFR-binding peptide
  MOD_RES (1)..(2): Xaa is C or S
XXAPTQLEPLTVLYY

SEQ ID NO: 3622 - protein, 15 aa, Artificial Sequence
  GFR-binding peptide
  MOD_RES (1)..(2): Xaa is C or S
XXVSQDLEPLPIVYY

SEQ ID NO: 3623 - protein, 12 aa, Artificial Sequence
  GFR-binding peptide
PTELEPLTMLYY

SEQ ID NO: 3624 - protein, 20 aa, Artificial Sequence
  GFR-binding peptide
  MOD_RES (6)..(7): Xaa is C or S
TVPKPXXAPTQLEPLTVLYY

SEQ ID NO: 3625 - protein, 17 aa, Artificial Sequence
  GFR-binding peptide
  MOD_RES (3)..(4): Xaa is C or S
KAXXAPTKLSPISVLYI

SEQ ID NO: 3626 - protein, 17 aa, Artificial Sequence
  GFR-binding peptide
  MOD_RES (3)..(4): Xaa is C or S
SPXXVPQDLSPISILFI

SEQ ID NO: 3627 - protein, 14 aa, Artificial Sequence
  GFR-binding peptide
  MOD_RES (1)..(1): Xaa is C or S
XAPTKLSPISVLFI

SEQ ID NO: 3628 - protein, 15 aa, Artificial Sequence
  GFR-binding peptide
  MOD_RES (1)..(2): Xaa is C or S
XXAPTQLSPISVLYI

SEQ ID NO: 3629 - protein, 13 aa, Artificial Sequence
  GFR-binding peptide
VPTRLSPISILYI

SEQ ID NO: 3630 - protein, 12 aa, Artificial Sequence
  GFR-binding peptide
PTKLEPLPVVYY

SEQ ID NO: 3631 - protein, 19 aa, Artificial Sequence
  GFR-binding peptide
  MOD_RES (6)..(6): Xaa is C or S
VTKPTXAPTKLSPISVLYI

SEQ ID NO: 3632 - protein, 16 aa, Artificial Sequence
  GFR-binding peptide
  MOD_RES (2)..(3): Xaa is C or S
PXXVPQALSPISILFI

SEQ ID NO: 3633 - protein, 15 aa, Artificial Sequence
  GFR-binding peptide
  MOD_RES (1)..(2): Xaa is C or S
XXVPTRLEPLTILYY

SEQ ID NO: 3634 - protein, 16 aa, Artificial Sequence
  GFR-binding peptide
  MOD_RES (2)..(3): Xaa is C or S
PXXAPTQLSPISVLFI

SEQ ID NO: 3635 - protein, 16 aa, Artificial Sequence
  GFR-binding peptide
  MOD_RES (2)..(3): Xaa is C or S
TXXVPTRLSPISILYI

SEQ ID NO: 3636 - protein, 10 aa, Artificial Sequence
  GFR-binding peptide
DLSPISILFI

SEQ ID NO: 3637 - protein, 20 aa, Artificial Sequence
  GFR-binding peptide
  MOD_RES (6)..(7): Xaa is C or S
KVGKAXXVPTKLSPISVLYI

SEQ ID NO: 3638 - protein, 19 aa, Artificial Sequence
  GFR-binding peptide
  MOD_RES (5)..(6): Xaa is C or S
VPKPXXAPTKLSPISVLFI

SEQ ID NO: 3639 - protein, 18 aa, Artificial Sequence
  GFR-binding peptide
  MOD_RES (4)..(5): Xaa is C or S
ASPXXVPQDLEPLPIVYY

SEQ ID NO: 3640 - protein, 15 aa, Artificial Sequence
  GFR-binding peptide
  MOD_RES (1)..(2): Xaa is C or S
XXVPQDLSPISILFI

SEQ ID NO: 3641 - protein, 19 aa, Artificial Sequence
  GFR-binding peptide
  MOD_RES (5)..(6): Xaa is C or S
SAAPXXVPQALEPLTILYY

SEQ ID NO: 3642 - protein, 18 aa, Artificial Sequence
  GFR-binding peptide
  MOD_RES (5)..(5): Xaa is C or S
TKPTXAPTKLSPISVLYI

SEQ ID NO: 3643 - protein, 14 aa, Artificial Sequence
  GFR-binding peptide
  MOD_RES (1)..(1): Xaa is C or S
XVPQDLSPISILFI

SEQ ID NO: 3644 - protein, 15 aa, Artificial Sequence
  GFR-binding peptide
  MOD_RES (2)..(2): Xaa is C or S
TXAPTKLSPISVLYI

SEQ ID NO: 3645 - protein, 18 aa, Artificial Sequence
  GFR-binding peptide
  MOD_RES (4)..(5): Xaa is C or S
PKAXXAPTKLSPISVLYI

SEQ ID NO: 3646 - protein, 12 aa, Artificial Sequence
  GFR-binding peptide
PTQLSPISVLFI

SEQ ID NO: 3647 - protein, 12 aa, Artificial Sequence
  GFR-binding peptide
PTKLSPISVLFI

SEQ ID NO: 3648 - protein, 12 aa, Artificial Sequence
  GFR-binding peptide
PTELSPISMLYI

SEQ ID NO: 3649 - protein, 10 aa, Artificial Sequence
  GFR-binding peptide
KLEPLPVVYY

SEQ ID NO: 3650 - protein, 19 aa, Artificial Sequence
  GFR-binding peptide
  MOD_RES (5)..(6): Xaa is C or S
TPPTXXVPTRLEPLPIVYY

SEQ ID NO: 3651 - protein, 12 aa, Artificial Sequence
  GFR-binding peptide
PQALEPLTILYY

SEQ ID NO: 3652 - protein, 9 aa, Artificial Sequence
  GFR-binding peptide
LSPISMLYI

SEQ ID NO: 3653 - protein, 20 aa, Artificial Sequence
  GFR-binding peptide
  MOD_RES (6)..(7): Xaa is C or S
KIPKAXXVPTELSPISMLYI

SEQ ID NO: 3654 - protein, 18 aa, Artificial Sequence
  GFR-binding peptide
  MOD_RES (4)..(5): Xaa is C or S
AGPXXTPTKMSPISMLYI

SEQ ID NO: 3655 - protein, 16 aa, Artificial Sequence
  GFR-binding peptide
  MOD_RES (2)..(3): Xaa is C or S
AXXVPTKLSPISVLYI

SEQ ID NO: 3656 - protein, 10 aa, Artificial Sequence
  GFR-binding peptide
KLSPISILYI

SEQ ID NO: 3657 - protein, 17 aa, Artificial Sequence
  GFR-binding peptide
  MOD_RES (3)..(4): Xaa is C or S
PTXXVPTRLEPLTILYY

SEQ ID NO: 3658 - protein, 10 aa, Artificial Sequence
  GFR-binding peptide
QLEPLPVVYY

SEQ ID NO: 3659 - protein, 15 aa, Artificial Sequence
  GFR-binding peptide
  MOD_RES (1)..(2): Xaa is C or S
XXVPTELSPISMLYI

SEQ ID NO: 3660 - protein, 18 aa, Artificial Sequence
  GFR-binding peptide
  MOD_RES (5)..(5): Xaa is C or S
TKPTXAPTKLEPLPVVYY

SEQ ID NO: 3661 - protein, 15 aa, Artificial Sequence
  GFR-binding peptide
  MOD_RES (1)..(2): Xaa is C or S
XXAPTKLSPISVLFI

SEQ ID NO: 3662 - protein, 17 aa, Artificial Sequence
  GFR-binding peptide
  MOD_RES (3)..(4): Xaa is C or S
KPXXAPTKLSPISVLYI

SEQ ID NO: 3663 - protein, 15 aa, Artificial Sequence
  GFR-binding peptide
  MOD_RES (1)..(2): Xaa is C or S
XXVPQALEPLTILYY

SEQ ID NO: 3664 - protein, 17 aa, Artificial Sequence
  GFR-binding peptide
  MOD_RES (3)..(4): Xaa is C or S
KPXXAPTQLSPISVLYI

SEQ ID NO: 3665 - protein, 12 aa, Artificial Sequence
  GFR-binding peptide
PTELEPLPMVYY

SEQ ID NO: 3666 - protein, 13 aa, Artificial Sequence
  GFR-binding peptide
APTKLEPLTVLYY

SEQ ID NO: 3667 - protein, 20 aa, Artificial Sequence
  GFR-binding peptide
  MOD_RES (6)..(7): Xaa is C or S
KIPKAXXVPTELEPLPMVYY

SEQ ID NO: 3668 - protein, 18 aa, Artificial Sequence
  GFR-binding peptide
  MOD_RES (4)..(5): Xaa is C or S
PPTXXVPTRLEPLPIVYY

SEQ ID NO: 3669 - protein, 10 aa, Artificial Sequence
  GFR-binding peptide
ALEPLTILYY

SEQ ID NO: 3670 - protein, 14 aa, Artificial Sequence
  GFR-binding peptide
  MOD_RES (1)..(1): Xaa is C or S
XVPQALEPLTILYY

SEQ ID NO: 3671 - protein, 17 aa, Artificial Sequence
  GFR-binding peptide
  MOD_RES (3)..(4): Xaa is C or S
SPXXVSQDLSPISILFI

SEQ ID NO: 3672 - protein, 14 aa, Artificial Sequence
  GFR-binding peptide
  MOD_RES (1)..(1): Xaa is C or S
XVPTELSPISMLYI

SEQ ID NO: 3673 - protein, 18 aa, Artificial Sequence
  GFR-binding peptide
  MOD_RES (4)..(5): Xaa is C or S
PKPXXAPTKLSPISVLFI

SEQ ID NO: 3674 - protein, 13 aa, Artificial Sequence
  GFR-binding peptide
APVKTSPISMLYI

SEQ ID NO: 3675 - protein, 9 aa, Artificial Sequence
  GFR-binding peptide
TSPISMLYI

SEQ ID NO: 3676 - protein, 18 aa, Artificial Sequence
  GFR-binding peptide
  MOD_RES (4)..(5): Xaa is C or S
PKPXXAPTQLSPISVLFI

SEQ ID NO: 3677 - protein, 19 aa, Artificial Sequence
  GFR-binding peptide
  MOD_RES (5)..(6): Xaa is C or S
VGKAXXVPTKLSPISVLYI

SEQ ID NO: 3678 - protein, 16 aa, Artificial Sequence
  GFR-binding peptide
  MOD_RES (2)..(3): Xaa is C or S
TXXAPVKTSPISMLYI

SEQ ID NO: 3679 - protein, 15 aa, Artificial Sequence
  GFR-binding peptide
  MOD_RES (1)..(2): Xaa is C or S
XXAPTQLSPISVLFI

SEQ ID NO: 3680 - protein, 19 aa, Artificial Sequence
  GFR-binding peptide
  MOD_RES (6)..(6): Xaa is C or S
VTKPTXAPTKLSPISVLFI

SEQ ID NO: 3681 - protein, 18 aa, Artificial Sequence
  GFR-binding peptide
  MOD_RES (4)..(5): Xaa is C or S
SKAXXVPTKLSPISILYI

SEQ ID NO: 3682 - protein, 18 aa, Artificial Sequence
  GFR-binding peptide
  MOD_RES (4)..(5): Xaa is C or S
PKPXXAPTKLSPISVLYI

SEQ ID NO: 3683 - protein, 12 aa, Artificial Sequence
  GFR-binding peptide
PQALSPISILFI

SEQ ID NO: 3684 - protein, 18 aa, Artificial Sequence
  GFR-binding peptide
  MOD_RES (5)..(5): Xaa is C or S
TKPTXAPTKLSPISVLFI

SEQ ID NO: 3685 - protein, 19 aa, Artificial Sequence
  GFR-binding peptide
  MOD_RES (5)..(6): Xaa is C or S
IPKAXXVPTELEPLPMVYY

SEQ ID NO: 3686 - protein, 15 aa, Artificial Sequence
  GFR-binding peptide
  MOD_RES (1)..(2): Xaa is C or S
XXAPTKLEPLTVLYY

SEQ ID NO: 3687 - protein, 12 aa, Artificial Sequence
  GFR-binding peptide
PTKLEPLTVLYY

SEQ ID NO: 3688 - protein, 12 aa, Artificial Sequence
  GFR-binding peptide
PTKLSPISVLYI

SEQ ID NO: 3689 - protein, 20 aa, Artificial Sequence
  GFR-binding peptide
  MOD_RES (7)..(7): Xaa is C or S
HVTKPTXAPTKLEPLTVLYY

SEQ ID NO: 3690 - protein, 20 aa, Artificial Sequence
  GFR-binding peptide
  MOD_RES (7)..(7): Xaa is C or S
HVTKPTXAPTKLSPISVLYI

SEQ ID NO: 3691 - protein, 11 aa, Artificial Sequence
  GFR-binding peptide
TRLSPISILYI

SEQ ID NO: 3692 - protein, 13 aa, Artificial Sequence
  GFR-binding peptide
APTKLSPISVLYI

SEQ ID NO: 3693 - protein, 12 aa, Artificial Sequence
  GFR-binding peptide
PQDLEPLPIVYY

SEQ ID NO: 3694 - protein, 13 aa, Artificial Sequence
  GFR-binding peptide
VPTRLEPLPIVYY

SEQ ID NO: 3695 - protein, 14 aa, Artificial Sequence
  GFR-binding peptide
  MOD_RES (1)..(1): Xaa is C or S
XAPTKLEPLPVVYY

SEQ ID NO: 3696 - protein, 12 aa, Artificial Sequence
  GFR-binding peptide
PQDLSPISILFI

SEQ ID NO: 3697 - protein, 20 aa, Artificial Sequence
  GFR-binding peptide
  MOD_RES (6)..(7): Xaa is C or S
KIPKAXXVPTELSPISMLFI

SEQ ID NO: 3698 - protein, 16 aa, Artificial Sequence
  GFR-binding peptide
  MOD_RES (2)..(3): Xaa is C or S
TXXVPTRLEPLPIVYY

SEQ ID NO: 3699 - protein, 18 aa, Artificial Sequence
  GFR-binding peptide
  MOD_RES (4)..(5): Xaa is C or S
PKPXXAPTQLEPLPVVYY

SEQ ID NO: 3700 - protein, 15 aa, Artificial Sequence
  GFR-binding peptide
  MOD_RES (2)..(2): Xaa is C or S
TXAPTKLEPLTVLYY

SEQ ID NO: 3701 - protein, 10 aa, Artificial Sequence
  GFR-binding peptide
ELEPLPMVYY

SEQ ID NO: 3702 - protein, 16 aa, Artificial Sequence
  GFR-binding peptide
  MOD_RES (2)..(3): Xaa is C or S
PXXAPTQLEPLTVLYY

SEQ ID NO: 3703 - protein, 19 aa, Artificial Sequence
  GFR-binding peptide
  MOD_RES (5)..(6): Xaa is C or S
SASPXXVSQDLEPLPIVYY

SEQ ID NO: 3704 - protein, 17 aa, Artificial Sequence
  GFR-binding peptide
  MOD_RES (3)..(4): Xaa is C or S
PTXXVPTRLSPISILYI

SEQ ID NO: 3705 - protein, 19 aa, Artificial Sequence
  GFR-binding peptide
  MOD_RES (6)..(6): Xaa is C or S
VTKPTXAPTKLEPLPVVYY

SEQ ID NO: 3706 - protein, 13 aa, Artificial Sequence
  GFR-binding peptide
APTQLEPLPVVYY

SEQ ID NO: 3707 - protein, 17 aa, Artificial Sequence
  GFR-binding peptide
  MOD_RES (3)..(4): Xaa is C or S
KAXXVPTKLSPISILYI

SEQ ID NO: 3708 - protein, 16 aa, Artificial Sequence
  GFR-binding peptide
  MOD_RES (2)..(3): Xaa is C or S
PXXVSQDLSPISILFI

SEQ ID NO: 3709 - protein, 16 aa, Artificial Sequence
  GFR-binding peptide
  MOD_RES (2)..(3): Xaa is C or S
AXXVPTELEPLPMVYY

SEQ ID NO: 3710 - protein, 17 aa, Artificial Sequence
  GFR-binding peptide
  MOD_RES (3)..(4): Xaa is C or S
STXXAPVKTSPISMLYI

SEQ ID NO: 3711 - protein, 12 aa, Artificial Sequence
  GFR-binding peptide
PTELSPISMLFI

SEQ ID NO: 3712 - protein, 11 aa, Artificial Sequence
  GFR-binding peptide
TRLEPLTILYY

SEQ ID NO: 3713 - protein, 14 aa, Artificial Sequence
  GFR-binding peptide
  MOD_RES (1)..(1): Xaa is C or S
XTPTKMSPISMLYI

SEQ ID NO: 3714 - protein, 11 aa, Artificial Sequence
  GFR-binding peptide
TKLSPISILYI

SEQ ID NO: 3715 - protein, 18 aa, Artificial Sequence
  GFR-binding peptide
  MOD_RES (4)..(5): Xaa is C or S
ASPXXVSQDLSPISILFI

SEQ ID NO: 3716 - protein, 17 aa, Artificial Sequence
  GFR-binding peptide
  MOD_RES (3)..(4): Xaa is C or S
KPXXAPTQLSPISVLFI

SEQ ID NO: 3717 - protein, 20 aa, Artificial Sequence
  GFR-binding peptide
  MOD_RES (6)..(7): Xaa is C or S
YVPKPXXAPTKLEPLPVVYY

SEQ ID NO: 3718 - protein, 14 aa, Artificial Sequence
  GFR-binding peptide
  MOD_RES (1)..(1): Xaa is C or S
XVPTELSPISMLFI

SEQ ID NO: 3719 - protein, 19 aa, Artificial Sequence
  GFR-binding peptide
  MOD_RES (5)..(6): Xaa is C or S
SAGPXXTPTKMSPISMLYI

SEQ ID NO: 3720 - protein, 12 aa, Artificial Sequence
  GFR-binding peptide
PTKMSPISMLYI

SEQ ID NO: 3721 - protein, 14 aa, Artificial Sequence
  GFR-binding peptide
  MOD_RES (1)..(1): Xaa is C or S
XVPQALSSLSILFF

SEQ ID NO: 3722 - protein, 20 aa, Artificial Sequence
  GFR-binding peptide
  MOD_RES (7)..(7): Xaa is C or S
HVTKPTXAPTKLSSLSVLFF

SEQ ID NO: 3723 - protein, 15 aa, Artificial Sequence
  GFR-binding peptide
QPSRVHHSSLSVLFF

SEQ ID NO: 3724 - protein, 13 aa, Artificial Sequence
  GFR-binding peptide
APTQLSSLSVLFF

SEQ ID NO: 3725 - protein, 19 aa, Artificial Sequence
  GFR-binding peptide
  MOD_RES (4)..(4): Xaa is C or S
SVKXQPSRVHHSSLSVLFF

SEQ ID NO: 3726 - protein, 10 aa, Artificial Sequence
  GFR-binding peptide
KMSSLSILFF

SEQ ID NO: 3727 - protein, 12 aa, Artificial Sequence
  GFR-binding peptide
PTEESSLSMLFF

SEQ ID NO: 3728 - protein, 16 aa, Artificial Sequence
  GFR-binding peptide
  MOD_RES (2)..(3): Xaa is C or S
PXXTPTKMSSLSMLFF

SEQ ID NO: 3729 - protein, 17 aa, Artificial Sequence
  GFR-binding peptide
  MOD_RES (4)..(4): Xaa is C or S
GLEXVPTEESSLSMLFF

SEQ ID NO: 3730 - protein, 13 aa, Artificial Sequence
  GFR-binding peptide
VPTKLSSLSILFF

SEQ ID NO: 3731 - protein, 20 aa, Artificial Sequence
  GFR-binding peptide
  MOD_RES (6)..(7): Xaa is C or S
GIPEPXXVPEKMSSLSILFF

SEQ ID NO: 3732 - protein, 9 aa, Artificial Sequence
  GFR-binding peptide
TSSLSMLFF

SEQ ID NO: 3733 - protein, 13 aa, Artificial Sequence
  GFR-binding peptide
APTKLSSLSVLFF

SEQ ID NO: 3734 - protein, 11 aa, Artificial Sequence
  GFR-binding peptide
ARLSSLSILFF

SEQ ID NO: 3735 - protein, 17 aa, Artificial Sequence
  GFR-binding peptide
  MOD_RES (3)..(4): Xaa is C or S
KAXXAPTKLSSLSVLFF

SEQ ID NO: 3736 - protein, 20 aa, Artificial Sequence
  GFR-binding peptide
  MOD_RES (6)..(7): Xaa is C or S
AAPASXXVPARLSSLSILFF

SEQ ID NO: 3737 - protein, 10 aa, Artificial Sequence
  GFR-binding peptide
QLSSLSVLFF

SEQ ID NO: 3738 - protein, 19 aa, Artificial Sequence
  GFR-binding peptide
  MOD_RES (5)..(6): Xaa is C or S
SASPXXVSQDLSSLSILFF

SEQ ID NO: 3739 - protein, 20 aa, Artificial Sequence
  GFR-binding peptide
  MOD_RES (7)..(7): Xaa is C or S
NDEGLEXVPTEESSLSMLFF

SEQ ID NO: 3740 - protein, 17 aa, Artificial Sequence
  GFR-binding peptide
  MOD_RES (2)..(2): Xaa is C or S
KXQPSRVHHSSLSVLFF

SEQ ID NO: 3741 - protein, 9 aa, Artificial Sequence
  GFR-binding peptide
ESSLSMLFF

SEQ ID NO: 3742 - protein, 19 aa, Artificial Sequence
  GFR-binding peptide
  MOD_RES (5)..(6): Xaa is C or S
VPKAXXAPTKLSSLSVLFF

SEQ ID NO: 3743 - protein, 15 aa, Artificial Sequence
  GFR-binding peptide
  MOD_RES (1)..(2): Xaa is C or S
XXVPARLSSLSILFF

SEQ ID NO: 3744 - protein, 16 aa, Artificial Sequence
  GFR-binding peptide
  MOD_RES (2)..(3): Xaa is C or S
SXXVPARLSSLSILFF

SEQ ID NO: 3745 - protein, 13 aa, Artificial Sequence
  GFR-binding peptide
VPTRLSSLSILFF

SEQ ID NO: 3746 - protein, 14 aa, Artificial Sequence
  GFR-binding peptide
PSRVHHSSLSVLFF

SEQ ID NO: 3747 - protein, 13 aa, Artificial Sequence
  GFR-binding peptide
VPQALSSLSILFF

SEQ ID NO: 3748 - protein, 17 aa, Artificial Sequence
  GFR-binding peptide
  MOD_RES (3)..(4): Xaa is C or S
KAXXVPTKLSSLSILFF

SEQ ID NO: 3749 - protein, 10 aa, Artificial Sequence
  GFR-binding peptide
ALSSLSILFF

SEQ ID NO: 3750 - protein, 14 aa, Artificial Sequence
  GFR-binding peptide
  MOD_RES (1)..(1): Xaa is C or S
XTPTKMSSLSMLFF

SEQ ID NO: 3751 - protein, 19 aa, Artificial Sequence
  GFR-binding peptide
  MOD_RES (5)..(6): Xaa is C or S
IPEPXXVPEKMSSLSILFF

SEQ ID NO: 3752 - protein, 20 aa, Artificial Sequence
  GFR-binding peptide
  MOD_RES (6)..(7): Xaa is C or S
YVPKPXXAPTKLSSLSVLFF

SEQ ID NO: 3753 - protein, 10 aa, Artificial Sequence
  GFR-binding peptide
KLSSLSVLFF

SEQ ID NO: 3754 - protein, 12 aa, Artificial Sequence
  GFR-binding peptide
PTKMSSLSMLFF

SEQ ID NO: 3755 - protein, 19 aa, Artificial Sequence
  GFR-binding peptide
  MOD_RES (5)..(6): Xaa is C or S
SASPXXVPQDLSSLSILFF

SEQ ID NO: 3756 - protein, 10 aa, Artificial Sequence
  GFR-binding peptide
RLSSLSILFF

SEQ ID NO: 3757 - protein, 18 aa, Artificial Sequence
  GFR-binding peptide
  MOD_RES (5)..(5): Xaa is C or S
EGLEXVPTEESSLSMLFF

SEQ ID NO: 3758 - protein, 17 aa, Artificial Sequence
  GFR-binding peptide
  MOD_RES (3)..(4): Xaa is C or S
PTXXVPTRLSSLSILFF

SEQ ID NO: 3759 - protein, 16 aa, Artificial Sequence
  GFR-binding peptide
  MOD_RES (3)..(3): Xaa is C or S
LEXVPTEESSLSMLFF

SEQ ID NO: 3760 - protein, 14 aa, Artificial Sequence
  GFR-binding peptide
  MOD_RES (1)..(1): Xaa is C or S
XVPEKMSSLSILFF

SEQ ID NO: 3761 - protein, 15 aa, Artificial Sequence
  GFR-binding peptide
  MOD_RES (1)..(2): Xaa is C or S
XXVSQDLSSLSILFF

SEQ ID NO: 3762 - protein, 20 aa, Artificial Sequence
  GFR-binding peptide
  MOD_RES (6)..(7): Xaa is C or S
KASKAXXVPTKLSSLSILFF

SEQ ID NO: 3763 - protein, 11 aa, Artificial Sequence
  GFR-binding peptide
TKMSSLSMLFF

SEQ ID NO: 3764 - protein, 18 aa, Artificial Sequence
  GFR-binding peptide
  MOD_RES (4)..(5): Xaa is C or S
PASXXVPARLSSLSILFF

SEQ ID NO: 3765 - protein, 17 aa, Artificial Sequence
  GFR-binding peptide
  MOD_RES (4)..(4): Xaa is C or S
KPTXAPTKLSSLSVLFF

SEQ ID NO: 3766 - protein, 18 aa, Artificial Sequence
  GFR-binding peptide
  MOD_RES (4)..(5): Xaa is C or S
PEPXXVPEKMSSLSILFF

SEQ ID NO: 3767 - protein, 16 aa, Artificial Sequence
  GFR-binding peptide
  MOD_RES (1)..(1): Xaa is C or S
XQPSRVHHSSLSVLFF

SEQ ID NO: 3768 - protein, 18 aa, Artificial Sequence
  GFR-binding peptide
  MOD_RES (4)..(5): Xaa is C or S
AGPXXTPTKMSSLSMLFF

SEQ ID NO: 3769 - protein, 20 aa, Artificial Sequence
  GFR-binding peptide
  MOD_RES (6)..(7): Xaa is C or S
STPPTXXVPTRLSSLSILFF

SEQ ID NO: 3770 - protein, 12 aa, Artificial Sequence
  GFR-binding peptide
SQDLSSLSILFF

SEQ ID NO: 3771 - protein, 14 aa, Artificial Sequence
  GFR-binding peptide
  MOD_RES (1)..(1): Xaa is C or S
XAPVKTSSLSMLFF

SEQ ID NO: 3772 - protein, 11 aa, Artificial Sequence
  GFR-binding peptide
TKLSSLSVLFF

SEQ ID NO: 3773 - protein, 10 aa, Artificial Sequence
  GFR-binding peptide
KLSSLSILFF

SEQ ID NO: 3774 - protein, 17 aa, Artificial Sequence
  GFR-binding peptide
  MOD_RES (3)..(4): Xaa is C or S
ASXXVPARLSSLSILFF

SEQ ID NO: 3775 - protein, 11 aa, Artificial Sequence
  GFR-binding peptide
TRLSSLSILFF

SEQ ID NO: 3776 - protein, 14 aa, Artificial Sequence
  GFR-binding peptide
  MOD_RES (1)..(1): Xaa is C or S
XAPTKLSSLSVLFF

SEQ ID NO: 3777 - protein, 9 aa, Artificial Sequence
  GFR-binding peptide
MSSLSMLFF

SEQ ID NO: 3778 - protein, 19 aa, Artificial Sequence
  GFR-binding peptide
  MOD_RES (5)..(6): Xaa is C or S
VPKPXXAPTKLSSLSVLFF

SEQ ID NO: 3779 - protein, 19 aa, Artificial Sequence
  GFR-binding peptide
  MOD_RES (5)..(6): Xaa is C or S
TPPTXXVPTRLSSLSILFF

SEQ ID NO: 3780 - protein, 17 aa, Artificial Sequence
  GFR-binding peptide
  MOD_RES (3)..(4): Xaa is C or S
SPXXVPQDLSSLSILFF

SEQ ID NO: 3781 - protein, 19 aa, Artificial Sequence
  GFR-binding peptide
  MOD_RES (6)..(6): Xaa is C or S
DEGLEXVPTEESSLSMLFF

SEQ ID NO: 3782 - protein, 13 aa, Artificial Sequence
  GFR-binding peptide
VPTEESSLSMLFF

SEQ ID NO: 3783 - protein, 11 aa, Artificial Sequence
  GFR-binding peptide
VHHSSLSVLFF

SEQ ID NO: 3784 - protein, 17 aa, Artificial Sequence
  GFR-binding peptide
  MOD_RES (3)..(4): Xaa is C or S
KPXXAPTKLSSLSVLFF

SEQ ID NO: 3785 - protein, 18 aa, Artificial Sequence
  GFR-binding peptide
  MOD_RES (4)..(5): Xaa is C or S
PKAXXAPTKLSSLSVLFF

SEQ ID NO: 3786 - protein, 19 aa, Artificial Sequence
  GFR-binding peptide
  MOD_RES (5)..(6): Xaa is C or S
SAAPXXVPQALSSLSILFF

SEQ ID NO: 3787 - protein, 18 aa, Artificial Sequence
  GFR-binding peptide
  MOD_RES (3)..(3): Xaa is C or S
VKXQPSRVHHSSLSVLFF

SEQ ID NO: 3788 - protein, 19 aa, Artificial Sequence
  GFR-binding peptide
  MOD_RES (5)..(6): Xaa is C or S
VGKAXXVPTKLSSLSVLFF

SEQ ID NO: 3789 - protein, 12 aa, Artificial Sequence
  GFR-binding peptide
PARLSSLSILFF

SEQ ID NO: 3790 - protein, 10 aa, Artificial Sequence
  GFR-binding peptide
EESSLSMLFF

SEQ ID NO: 3791 - protein, 16 aa, Artificial Sequence
  GFR-binding peptide
  MOD_RES (2)..(3): Xaa is C or S
PXXVPQALSSLSILFF

SEQ ID NO: 3792 - protein, 20 aa, Artificial Sequence
  GFR-binding peptide
  MOD_RES (6)..(7): Xaa is C or S
ASASPXXVPQDLSSLSILFF

SEQ ID NO: 3793 - protein, 16 aa, Artificial Sequence
  GFR-binding peptide
  MOD_RES (2)..(3): Xaa is C or S
PXXAPTQLSSLSVLFF

SEQ ID NO: 3794 - protein, 19 aa, Artificial Sequence
  GFR-binding peptide
  MOD_RES (5)..(6): Xaa is C or S
ASKAXXVPTKLSSLSILFF

SEQ ID NO: 3795 - protein, 15 aa, Artificial Sequence
  GFR-binding peptide
  MOD_RES (1)..(2): Xaa is C or S
XXVPQDLSSLSILFF

SEQ ID NO: 3796 - protein, 15 aa, Artificial Sequence
  GFR-binding peptide
  MOD_RES (2)..(2): Xaa is C or S
EXVPTEESSLSMLFF

SEQ ID NO: 3797 - protein, 12 aa, Artificial Sequence
  GFR-binding peptide
PEKMSSLSILFF

SEQ ID NO: 3798 - protein, 10 aa, Artificial Sequence
  GFR-binding peptide
DLSSLSILFF

SEQ ID NO: 3799 - protein, 14 aa, Artificial Sequence
  GFR-binding peptide
  MOD_RES (1)..(1): Xaa is C or S
XVPARLSSLSILFF

SEQ ID NO: 3800 - protein, 17 aa, Artificial Sequence
  GFR-binding peptide
  MOD_RES (3)..(4): Xaa is C or S
KAXXVPTKLSSLSVLFF

SEQ ID NO: 3801 - protein, 20 aa, Artificial Sequence
  GFR-binding peptide
  MOD_RES (6)..(7): Xaa is C or S
AVPKAXXAPTKLSSLSVLFF

SEQ ID NO: 3802 - protein, 15 aa, Artificial Sequence
  GFR-binding peptide
  MOD_RES (2)..(2): Xaa is C or S
TXAPTKLSSLSVLFF

SEQ ID NO: 3803 - protein, 13 aa, Artificial Sequence
  GFR-binding peptide
VPQDLSSLSILFF

SEQ ID NO: 3804 - protein, 19 aa, Artificial Sequence
  GFR-binding peptide
  MOD_RES (5)..(6): Xaa is C or S
SAGPXXTPTKMSSLSMLFF

SEQ ID NO: 3805 - protein, 20 aa, Artificial Sequence
  GFR-binding peptide
  MOD_RES (6)..(7): Xaa is C or S
HVPKPXXAPTKLSSLSVLFF

SEQ ID NO: 3806 - protein, 13 aa, Artificial Sequence
  GFR-binding peptide
VPARLSSLSILFF

SEQ ID NO: 3807 - protein, 12 aa, Artificial Sequence
  GFR-binding peptide
PTKLSSLSVLFF

SEQ ID NO: 3808 - protein, 15 aa, Artificial Sequence
  GFR-binding peptide
  MOD_RES (1)..(2): Xaa is C or S
XXVPTRLSSLSILFF

SEQ ID NO: 3809 - protein, 13 aa, Artificial Sequence
  GFR-binding peptide
SRVHHSSLSVLFF

SEQ ID NO: 3810 - protein, 14 aa, Artificial Sequence
  GFR-binding peptide
  MOD_RES (1)..(1): Xaa is C or S
XVPQDLSSLSILFF

SEQ ID NO: 3811 - protein, 16 aa, Artificial Sequence
  GFR-binding peptide
  MOD_RES (2)..(3): Xaa is C or S
AXXVPTKLSSLSILFF

SEQ ID NO: 3812 - protein, 9 aa, Artificial Sequence
  GFR-binding peptide
HSSLSVLFF

SEQ ID NO: 3813 - protein, 12 aa, Artificial Sequence
  GFR-binding peptide
PTRLSSLSILFF

SEQ ID NO: 3814 - protein, 18 aa, Artificial Sequence
  GFR-binding peptide
  MOD_RES (4)..(5): Xaa is C or S
PKPXXAPTKLSSLSVLFF

SEQ ID NO: 3815 - protein, 17 aa, Artificial Sequence
  GFR-binding peptide
  MOD_RES (3)..(4): Xaa is C or S
APXXVPQALSSLSILFF

SEQ ID NO: 3816 - protein, 16 aa, Artificial Sequence
  GFR-binding peptide
  MOD_RES (2)..(3): Xaa is C or S
PXXVPEKMSSLSILFF

SEQ ID NO: 3817 - protein, 15 aa, Artificial Sequence
  GFR-binding peptide
  MOD_RES (1)..(2): Xaa is C or S
XXVPTKLSSLSVLFF

SEQ ID NO: 3818 - protein, 16 aa, Artificial Sequence
  GFR-binding peptide
  MOD_RES (3)..(3): Xaa is C or S
PTXAPTKLSSLSVLFF

SEQ ID NO: 3819 - protein, 15 aa, Artificial Sequence
  GFR-binding peptide
  MOD_RES (1)..(2): Xaa is C or S
XXVPEKMSSLSILFF

SEQ ID NO: 3820 - protein, 14 aa, Artificial Sequence
  GFR-binding peptide
  MOD_RES (1)..(1): Xaa is C or S
XVSQDLSSLSILFF

SEQ ID NO: 3821 - protein, 10 aa, Artificial Sequence
  GFR-binding peptide
KMSSLSMLFF

SEQ ID NO: 3822 - protein, 9 aa, Artificial Sequence
  GFR-binding peptide
LSSLSVLFF

SEQ ID NO: 3823 - protein, 13 aa, Artificial Sequence
  GFR-binding peptide
VSQDLSSLSILFF

SEQ ID NO: 3824 - protein, 11 aa, Artificial Sequence
  GFR-binding peptide
VKTSSLSMLFF

SEQ ID NO: 3825 - protein, 15 aa, Artificial Sequence
  GFR-binding peptide
  MOD_RES (1)..(2): Xaa is C or S
XXVPTKLSSLSILFF

SEQ ID NO: 3826 - protein, 11 aa, Artificial Sequence
  GFR-binding peptide
QALSSLSILFF

SEQ ID NO: 3827 - protein, 19 aa, Artificial Sequence
  GFR-binding peptide
  MOD_RES (5)..(6): Xaa is C or S
APASXXVPARLSSLSILFF

SEQ ID NO: 3828 - protein, 15 aa, Artificial Sequence
  GFR-binding peptide
  MOD_RES (1)..(2): Xaa is C or S
XXAPTKLSSLSVLFF

SEQ ID NO: 3829 - protein, 11 aa, Artificial Sequence
  GFR-binding peptide
EKMSSLSILFF

SEQ ID NO: 3830 - protein, 16 aa, Artificial Sequence
  GFR-binding peptide
  MOD_RES (2)..(3): Xaa is C or S
AXXAPTKLSSLSVLFF

SEQ ID NO: 3831 - protein, 16 aa, Artificial Sequence
  GFR-binding peptide
  MOD_RES (2)..(3): Xaa is C or S
PXXVPQDLSSLSILFF

SEQ ID NO: 3832 - protein, 18 aa, Artificial Sequence
  GFR-binding peptide
  MOD_RES (4)..(5): Xaa is C or S
ASPXXVPQDLSSLSILFF

SEQ ID NO: 3833 - protein, 17 aa, Artificial Sequence
  GFR-binding peptide
  MOD_RES (3)..(4): Xaa is C or S
SPXXVSQDLSSLSILFF

SEQ ID NO: 3834 - protein, 9 aa, Artificial Sequence
  GFR-binding peptide
LSSLSILFF

SEQ ID NO: 3835 - protein, 20 aa, Artificial Sequence
  GFR-binding peptide
  MOD_RES (6)..(7): Xaa is C or S
KVGKAXXVPTKLSSLSVLFF

SEQ ID NO: 3836 - protein, 19 aa, Artificial Sequence
  GFR-binding peptide
  MOD_RES (5)..(6): Xaa is C or S
VPSTXXAPVKTSSLSMLFF

SEQ ID NO: 3837 - protein, 17 aa, Artificial Sequence
  GFR-binding peptide
  MOD_RES (3)..(4): Xaa is C or S
STXXAPVKTSSLSMLFF

SEQ ID NO: 3838 - protein, 15 aa, Artificial Sequence
  GFR-binding peptide
  MOD_RES (1)..(2): Xaa is C or S
XXVPQALSSLSILFF

SEQ ID NO: 3839 - protein, 20 aa, Artificial Sequence
  GFR-binding peptide
  MOD_RES (6)..(7): Xaa is C or S
ASASPXXVSQDLSSLSILFF

SEQ ID NO: 3840 - protein, 18 aa, Artificial Sequence
  GFR-binding peptide
  MOD_RES (4)..(5): Xaa is C or S
GKAXXVPTKLSSLSVLFF

SEQ ID NO: 3841 - protein, 18 aa, Artificial Sequence
  GFR-binding peptide
  MOD_RES (4)..(5): Xaa is C or S
PKPXXAPTQLSSLSVLFF

SEQ ID NO: 3842 - protein, 15 aa, Artificial Sequence
  GFR-binding peptide
  MOD_RES (1)..(2): Xaa is C or S
XXAPTQLSSLSVLFF

SEQ ID NO: 3843 - protein, 12 aa, Artificial Sequence
  GFR-binding peptide
PTQLSSLSVLFF

SEQ ID NO: 3844 - protein, 11 aa, Artificial Sequence
  GFR-binding peptide
TKLSSLSILFF

SEQ ID NO: 3845 - protein, 13 aa, Artificial Sequence
  GFR-binding peptide
TPTKMSSLSMLFF

SEQ ID NO: 3846 - protein, 19 aa, Artificial Sequence
  GFR-binding peptide
  MOD_RES (6)..(6): Xaa is C or S
VTKPTXAPTKLSSLSVLFF

SEQ ID NO: 3847 - protein, 17 aa, Artificial Sequence
  GFR-binding peptide
  MOD_RES (3)..(4): Xaa is C or S
GPXXTPTKMSSLSMLFF

SEQ ID NO: 3848 - protein, 20 aa, Artificial Sequence
  GFR-binding peptide
  MOD_RES (6)..(7): Xaa is C or S
ASAAPXXVPQALSSLSILFF

SEQ ID NO: 3849 - protein, 14 aa, Artificial Sequence
  GFR-binding peptide
  MOD_RES (1)..(1): Xaa is C or S
XVPTEESSLSMLFF

SEQ ID NO: 3850 - protein, 16 aa, Artificial Sequence
  GFR-binding peptide
  MOD_RES (2)..(3): Xaa is C or S
TXXVPTRLSSLSILFF

SEQ ID NO: 3851 - protein, 13 aa, Artificial Sequence
  GFR-binding peptide
APVKTSSLSMLFF

SEQ ID NO: 3852 - protein, 12 aa, Artificial Sequence
  GFR-binding peptide
PQALSSLSILFF

SEQ ID NO: 3853 - protein, 14 aa, Artificial Sequence
  GFR-binding peptide
  MOD_RES (1)..(1): Xaa is C or S
XVPTKLSSLSVLFF

SEQ ID NO: 3854 - protein, 12 aa, Artificial Sequence
  GFR-binding peptide
PTKLSSLSILFF

SEQ ID NO: 3855 - protein, 16 aa, Artificial Sequence
  GFR-binding peptide
  MOD_RES (2)..(3): Xaa is C or S
AXXVPTKLSSLSVLFF

SEQ ID NO: 3856 - protein, 14 aa, Artificial Sequence
  GFR-binding peptide
  MOD_RES (1)..(1): Xaa is C or S
XVPTRLSSLSILFF

SEQ ID NO: 3857 - protein, 13 aa, Artificial Sequence
  GFR-binding peptide
VPTKLSSLSVLFF

SEQ ID NO: 3858 - protein, 16 aa, Artificial Sequence
  GFR-binding peptide
  MOD_RES (2)..(3): Xaa is C or S
PXXAPTKLSSLSVLFF

SEQ ID NO: 3859 - protein, 12 aa, Artificial Sequence
  GFR-binding peptide
PVKTSSLSMLFF

SEQ ID NO: 3860 - protein, 12 aa, Artificial Sequence
  GFR-binding peptide
PQDLSSLSILFF

SEQ ID NO: 3861 - protein, 11 aa, Artificial Sequence
  GFR-binding peptide
TEESSLSMLFF

SEQ ID NO: 3862 - protein, 13 aa, Artificial Sequence
  GFR-binding peptide
VPEKMSSLSILFF

SEQ ID NO: 3863 - protein, 20 aa, Artificial Sequence
  GFR-binding peptide
  MOD_RES (5)..(5): Xaa is C or S
SSVKXQPSRVHHSSLSVLFF

SEQ ID NO: 3864 - protein, 12 aa, Artificial Sequence
  GFR-binding peptide
RVHHSSLSVLFF

SEQ ID NO: 3865 - protein, 10 aa, Artificial Sequence
  GFR-binding peptide
KTSSLSMLFF

SEQ ID NO: 3866 - protein, 18 aa, Artificial Sequence
  GFR-binding peptide
  MOD_RES (4)..(5): Xaa is C or S
PSTXXAPVKTSSLSMLFF

SEQ ID NO: 3867 - protein, 15 aa, Artificial Sequence
  GFR-binding peptide
  MOD_RES (1)..(2): Xaa is C or S
XXTPTKMSSLSMLFF

SEQ ID NO: 3868 - protein, 16 aa, Artificial Sequence
  GFR-binding peptide
  MOD_RES (2)..(3): Xaa is C or S
PXXVSQDLSSLSILFF

SEQ ID NO: 3869 - protein, 10 aa, Artificial Sequence
  GFR-binding peptide
HHSSLSVLFF

SEQ ID NO: 3870 - protein, 17 aa, Artificial Sequence
  GFR-binding peptide
  MOD_RES (3)..(4): Xaa is C or S
EPXXVPEKMSSLSILFF

SEQ ID NO: 3871 - protein, 15 aa, Artificial Sequence
  GFR-binding peptide
  MOD_RES (1)..(2): Xaa is C or S
XXAPVKTSSLSMLFF

SEQ ID NO: 3872 - protein, 11 aa, Artificial Sequence
  GFR-binding peptide
TQLSSLSVLFF

SEQ ID NO: 3873 - protein, 9 aa, Artificial Sequence
  GFR-binding peptide
MSSLSILFF

SEQ ID NO: 3874 - protein, 14 aa, Artificial Sequence
  GFR-binding peptide
  MOD_RES (1)..(1): Xaa is C or S
XAPTQLSSLSVLFF

SEQ ID NO: 3875 - protein, 11 aa, Artificial Sequence
  GFR-binding peptide
QDLSSLSILFF

SEQ ID NO: 3876 - protein, 18 aa, Artificial Sequence
  GFR-binding peptide
  MOD_RES (4)..(5): Xaa is C or S
SKAXXVPTKLSSLSILFF

SEQ ID NO: 3877 - protein, 18 aa, Artificial Sequence
  GFR-binding peptide
  MOD_RES (5)..(5): Xaa is C or S
TKPTXAPTKLSSLSVLFF

SEQ ID NO: 3878 - protein, 14 aa, Artificial Sequence
  GFR-binding peptide
  MOD_RES (1)..(1): Xaa is C or S
XVPTKLSSLSILFF

SEQ ID NO: 3879 - protein, 16 aa, Artificial Sequence
  GFR-binding peptide
  MOD_RES (2)..(3): Xaa is C or S
TXXAPVKTSSLSMLFF

SEQ ID NO: 3880 - protein, 20 aa, Artificial Sequence
  GFR-binding peptide
  MOD_RES (6)..(7): Xaa is C or S
TVPKPXXAPTQLSSLSVLFF

SEQ ID NO: 3881 - protein, 18 aa, Artificial Sequence
  GFR-binding peptide
  MOD_RES (4)..(5): Xaa is C or S
AAPXXVPQALSSLSILFF

SEQ ID NO: 3882 - protein, 19 aa, Artificial Sequence
  GFR-binding peptide
  MOD_RES (5)..(6): Xaa is C or S
VPKPXXAPTQLSSLSVLFF

SEQ ID NO: 3883 - protein, 18 aa, Artificial Sequence
  GFR-binding peptide
  MOD_RES (4)..(5): Xaa is C or S
PPTXXVPTRLSSLSILFF

SEQ ID NO: 3884 - protein, 18 aa, Artificial Sequence
  GFR-binding peptide
  MOD_RES (4)..(5): Xaa is C or S
ASPXXVSQDLSSLSILFF

SEQ ID NO: 3885 - protein, 17 aa, Artificial Sequence
  GFR-binding peptide
  MOD_RES (3)..(4): Xaa is C or S
KPXXAPTQLSSLSVLFF

SEQ ID NO: 3886 - protein, 14 aa, Artificial Sequence
  GFR-binding peptide
  MOD_RES (14)..(14): Xaa is C or S
FFLISLSSLAQPVX

SEQ ID NO: 3887 - protein, 11 aa, Artificial Sequence
  GFR-binding peptide
FFLMSLSSLET

SEQ ID NO: 3888 - protein, 20 aa, Artificial Sequence
  GFR-binding peptide
  MOD_RES (14)..(14): Xaa is C or S
FFLVSLSSLKTPAXTPKTVH

SEQ ID NO: 3889 - protein, 15 aa, Artificial Sequence
  GFR-binding peptide
FFLVSLSSHHVRSPQ

SEQ ID NO: 3890 - protein, 13 aa, Artificial Sequence
  GFR-binding peptide
FFLVSLSSLQTPA

SEQ ID NO: 3891 - protein, 19 aa, Artificial Sequence
  GFR-binding peptide
  MOD_RES (16)..(16): Xaa is C or S
FFLVSLSSHHVRSPQXKVS

SEQ ID NO: 3892 - protein, 10 aa, Artificial Sequence
  GFR-binding peptide
FFLISLSSMK

SEQ ID NO: 3893 - protein, 12 aa, Artificial Sequence
  GFR-binding peptide
FFLMSLSSEETP

SEQ ID NO: 3894 - protein, 16 aa, Artificial Sequence
  GFR-binding peptide
  MOD_RES (14)..(15): Xaa is C or S
FFLMSLSSMKTPTXXP

SEQ ID NO: 3895 - protein, 17 aa, Artificial Sequence
  GFR-binding peptide
  MOD_RES (14)..(14): Xaa is C or S
FFLMSLSSEETPVXELG

SEQ ID NO: 3896 - protein, 13 aa, Artificial Sequence
  GFR-binding peptide
FFLISLSSLKTPV

SEQ ID NO: 3897 - protein, 20 aa, Artificial Sequence
  GFR-binding peptide
  MOD_RES (14)..(15): Xaa is C or S
FFLISLSSMKEPVXXPEPIG

SEQ ID NO: 3898 - protein, 9 aa, Artificial Sequence
  GFR-binding peptide
FFLMSLSST

SEQ ID NO: 3899 - protein, 13 aa, Artificial Sequence
  GFR-binding peptide
FFLVSLSSLKTPA

SEQ ID NO: 3900 - protein, 11 aa, Artificial Sequence
  GFR-binding peptide
FFLISLSSLRA

SEQ ID NO: 3901 - protein, 17 aa, Artificial Sequence
  GFR-binding peptide
  MOD_RES (14)..(15): Xaa is C or S
FFLVSLSSLKTPAXXAK

SEQ ID NO: 3902 - protein, 20 aa, Artificial Sequence
  GFR-binding peptide
  MOD_RES (14)..(15): Xaa is C or S
FFLISLSSLRAPVXXSAPAA

SEQ ID NO: 3903 - protein, 10 aa, Artificial Sequence
  GFR-binding peptide
FFLVSLSSLQ

SEQ ID NO: 3904 - protein, 19 aa, Artificial Sequence
  GFR-binding peptide
  MOD_RES (14)..(15): Xaa is C or S
FFLISLSSLDQSVXXPSAS

SEQ ID NO: 3905 - protein, 17 aa, Artificial Sequence
  GFR-binding peptide
  MOD_RES (16)..(16): Xaa is C or S
FFLVSLSSHHVRSPQXK

SEQ ID NO: 3906 - protein, 9 aa, Artificial Sequence
  GFR-binding peptide
FFLMSLSSE

SEQ ID NO: 3907 - protein, 19 aa, Artificial Sequence
  GFR-binding peptide
  MOD_RES (14)..(15): Xaa is C or S
FFLVSLSSLKTPAXXAKPV

SEQ ID NO: 3908 - protein, 15 aa, Artificial Sequence
  GFR-binding peptide
  MOD_RES (14)..(15): Xaa is C or S
FFLISLSSLRAPVXX

SEQ ID NO: 3909 - protein, 16 aa, Artificial Sequence
  GFR-binding peptide
  MOD_RES (14)..(15): Xaa is C or S
FFLISLSSLRAPVXXS

SEQ ID NO: 3910 - protein, 13 aa, Artificial Sequence
  GFR-binding peptide
FFLISLSSLRTPV

SEQ ID NO: 3911 - protein, 15 aa, Artificial Sequence
  GFR-binding peptide
  MOD_RES (14)..(15): Xaa is C or S
FFLMSLSSLETPVXX

SEQ ID NO: 3912 - protein, 14 aa, Artificial Sequence
  GFR-binding peptide
FFLVSLSSHHVRSP

SEQ ID NO: 3913 - protein, 13 aa, Artificial Sequence
  GFR-binding peptide
FFLISLSSLAQPV

SEQ ID NO: 3914 - protein, 17 aa, Artificial Sequence
  GFR-binding peptide
  MOD_RES (14)..(15): Xaa is C or S
FFLISLSSLKTPVXXAK

SEQ ID NO: 3915 - protein, 10 aa, Artificial Sequence
  GFR-binding peptide
FFLISLSSLA

SEQ ID NO: 3916 - protein, 14 aa, Artificial Sequence
  GFR-binding peptide
  MOD_RES (14)..(14): Xaa is C or S
FFLMSLSSMKTPTX

SEQ ID NO: 3917 - protein, 19 aa, Artificial Sequence
  GFR-binding peptide
  MOD_RES (14)..(15): Xaa is C or S
FFLISLSSMKEPVXXPEPI

SEQ ID NO: 3918 - protein, 20 aa, Artificial Sequence
  GFR-binding peptide
  MOD_RES (14)..(15): Xaa is C or S
FFLVSLSSLKTPAXXPKPVY

SEQ ID NO: 3919 - protein, 10 aa, Artificial Sequence
  GFR-binding peptide
FFLVSLSSLK

SEQ ID NO: 3920 - protein, 12 aa, Artificial Sequence
  GFR-binding peptide
FFLMSLSSMKTP

SEQ ID NO: 3921 - protein, 20 aa, Artificial Sequence
  GFR-binding peptide
  MOD_RES (14)..(15): Xaa is C or S
FFLMSLSSLETPVXXAKPIS

SEQ ID NO: 3922 - protein, 19 aa, Artificial Sequence
  GFR-binding peptide
  MOD_RES (14)..(15): Xaa is C or S
FFLISLSSLDQPVXXPSAS

SEQ ID NO: 3923 - protein, 9 aa, Artificial Sequence
  GFR-binding peptide
FFLMSLSSL

SEQ ID NO: 3924 - protein, 10 aa, Artificial Sequence
  GFR-binding peptide
FFLISLSSLR

SEQ ID NO: 3925 - protein, 18 aa, Artificial Sequence
  GFR-binding peptide
  MOD_RES (14)..(14): Xaa is C or S
FFLMSLSSEETPVXELGE

SEQ ID NO: 3926 - protein, 17 aa, Artificial Sequence
  GFR-binding peptide
  MOD_RES (14)..(15): Xaa is C or S
FFLISLSSLRTPVXXTP

SEQ ID NO: 3927 - protein, 16 aa, Artificial Sequence
  GFR-binding peptide
  MOD_RES (14)..(14): Xaa is C or S
FFLMSLSSEETPVXEL

SEQ ID NO: 3928 - protein, 16 aa, Artificial Sequence
  GFR-binding peptide
  MOD_RES (14)..(15): Xaa is C or S
FFLMSLSSLETPVXXA

SEQ ID NO: 3929 - protein, 14 aa, Artificial Sequence
  GFR-binding peptide
  MOD_RES (14)..(14): Xaa is C or S
FFLISLSSMKEPVX

SEQ ID NO: 3930 - protein, 15 aa, Artificial Sequence
  GFR-binding peptide
  MOD_RES (14)..(15): Xaa is C or S
FFLISLSSLDQSVXX

SEQ ID NO: 3931 - protein, 20 aa, Artificial Sequence
  GFR-binding peptide
  MOD_RES (14)..(15): Xaa is C or S
FFLISLSSLKTPVXXAKSAK

SEQ ID NO: 3932 - protein, 11 aa, Artificial Sequence
  GFR-binding peptide
FFLMSLSSMKT

SEQ ID NO: 3933 - protein, 18 aa, Artificial Sequence
  GFR-binding peptide
  MOD_RES (14)..(15): Xaa is C or S
FFLISLSSLRAPVXXSAP

SEQ ID NO: 3934 - protein, 17 aa, Artificial Sequence
  GFR-binding peptide
  MOD_RES (14)..(14): Xaa is C or S
FFLVSLSSLKTPAXTPK

SEQ ID NO: 3935 - protein, 18 aa, Artificial Sequence
  GFR-binding peptide
  MOD_RES (14)..(15): Xaa is C or S
FFLISLSSMKEPVXXPEP

SEQ ID NO: 3936 - protein, 16 aa, Artificial Sequence
  GFR-binding peptide
  MOD_RES (16)..(16): Xaa is C or S
FFLVSLSSHHVRSPQX

SEQ ID NO: 3937 - protein, 18 aa, Artificial Sequence
  GFR-binding peptide
  MOD_RES (14)..(15): Xaa is C or S
FFLMSLSSMKTPTXXPGA

SEQ ID NO: 3938 - protein, 10 aa, Artificial Sequence
  GFR-binding peptide
FFLMSLSSLE

SEQ ID NO: 3939 - protein, 20 aa, Artificial Sequence
  GFR-binding peptide
  MOD_RES (14)..(15): Xaa is C or S
FFLISLSSLRTPVXXTPPTS

SEQ ID NO: 3940 - protein, 12 aa, Artificial Sequence
  GFR-binding peptide
FFLISLSSLDQS

SEQ ID NO: 3941 - protein, 14 aa, Artificial Sequence
  GFR-binding peptide
  MOD_RES (14)..(14): Xaa is C or S
FFLMSLSSTKVPAX

SEQ ID NO: 3942 - protein, 8 aa, Artificial Sequence
  GFR-binding peptide
FFLMSLSS

SEQ ID NO: 3943 - protein, 11 aa, Artificial Sequence
  GFR-binding peptide
FFLVSLSSLKT

SEQ ID NO: 3944 - protein, 10 aa, Artificial Sequence
  GFR-binding peptide
FFLISLSSLK

SEQ ID NO: 3945 - protein, 19 aa, Artificial Sequence
  GFR-binding peptide
  MOD_RES (14)..(15): Xaa is C or S
FFLMSLSSLETPVXXAKPI

SEQ ID NO: 3946 - protein, 17 aa, Artificial Sequence
  GFR-binding peptide
  MOD_RES (14)..(15): Xaa is C or S
FFLISLSSLRAPVXXSA

SEQ ID NO: 3947 - protein, 11 aa, Artificial Sequence
  GFR-binding peptide
FFLISLSSLRT

SEQ ID NO: 3948 - protein, 14 aa, Artificial Sequence
  GFR-binding peptide
  MOD_RES (14)..(14): Xaa is C or S
FFLVSLSSLKTPAX

SEQ ID NO: 3949 - protein, 9 aa, Artificial Sequence
  GFR-binding peptide
FFLMSLSSM

SEQ ID NO: 3950 - protein, 19 aa, Artificial Sequence
  GFR-binding peptide
  MOD_RES (14)..(15): Xaa is C or S
FFLVSLSSLKTPAXXPKPV

SEQ ID NO: 3951 - protein, 19 aa, Artificial Sequence
  GFR-binding peptide
  MOD_RES (14)..(15): Xaa is C or S
FFLISLSSLRTPVXXTPPT

SEQ ID NO: 3952 - protein, 17 aa, Artificial Sequence
  GFR-binding peptide
  MOD_RES (14)..(15): Xaa is C or S
FFLISLSSLDQPVXXPS

SEQ ID NO: 3953 - protein, 19 aa, Artificial Sequence
  GFR-binding peptide
  MOD_RES (14)..(14): Xaa is C or S
FFLMSLSSEETPVXELGED

SEQ ID NO: 3954 - protein, 13 aa, Artificial Sequence
  GFR-binding peptide
FFLMSLSSEETPV

SEQ ID NO: 3955 - protein, 11 aa, Artificial Sequence
  GFR-binding peptide
FFLVSLSSHHV

SEQ ID NO: 3956 - protein, 17 aa, Artificial Sequence
  GFR-binding peptide
  MOD_RES (14)..(15): Xaa is C or S
FFLVSLSSLKTPAXXPK

SEQ ID NO: 3957 - protein, 18 aa, Artificial Sequence
  GFR-binding peptide
  MOD_RES (14)..(15): Xaa is C or S
FFLVSLSSLKTPAXXAKP

SEQ ID NO: 3958 - protein, 19 aa, Artificial Sequence
  GFR-binding peptide
  MOD_RES (14)..(15): Xaa is C or S
FFLISLSSLAQPVXXPAAS

SEQ ID NO: 3959 - protein, 18 aa, Artificial Sequence
  GFR-binding peptide
  MOD_RES (16)..(16): Xaa is C or S
FFLVSLSSHHVRSPQXKV

SEQ ID NO: 3960 - protein, 19 aa, Artificial Sequence
  GFR-binding peptide
  MOD_RES (14)..(15): Xaa is C or S
FFLVSLSSLKTPVXXAKGV

SEQ ID NO: 3961 - protein, 12 aa, Artificial Sequence
  GFR-binding peptide
FFLISLSSLRAP

SEQ ID NO: 3962 - protein, 10 aa, Artificial Sequence
  GFR-binding peptide
FFLMSLSSEE

SEQ ID NO: 3963 - protein, 16 aa, Artificial Sequence
  GFR-binding peptide
  MOD_RES (14)..(15): Xaa is C or S
FFLISLSSLAQPVXXP

SEQ ID NO: 3964 - protein, 20 aa, Artificial Sequence
  GFR-binding peptide
  MOD_RES (14)..(15): Xaa is C or S
FFLISLSSLDQPVXXPSASA

SEQ ID NO: 3965 - protein, 16 aa, Artificial Sequence
  GFR-binding peptide
  MOD_RES (14)..(15): Xaa is C or S
FFLVSLSSLQTPAXXP

SEQ ID NO: 3966 - protein, 19 aa, Artificial Sequence
  GFR-binding peptide
  MOD_RES (14)..(15): Xaa is C or S
FFLISLSSLKTPVXXAKSA

SEQ ID NO: 3967 - protein, 15 aa, Artificial Sequence
  GFR-binding peptide
  MOD_RES (14)..(15): Xaa is C or S
FFLISLSSLDQPVXX

SEQ ID NO: 3968 - protein, 15 aa, Artificial Sequence
  GFR-binding peptide
  MOD_RES (14)..(14): Xaa is C or S
FFLMSLSSEETPVXE

SEQ ID NO: 3969 - protein, 12 aa, Artificial Sequence
  GFR-binding peptide
FFLISLSSMKEP

SEQ ID NO: 3970 - protein, 10 aa, Artificial Sequence
  GFR-binding peptide
FFLISLSSLD

SEQ ID NO: 3971 - protein, 14 aa, Artificial Sequence
  GFR-binding peptide
  MOD_RES (14)..(14): Xaa is C or S
FFLISLSSLRAPVX

SEQ ID NO: 3972 - protein, 17 aa, Artificial Sequence
  GFR-binding peptide
  MOD_RES (14)..(15): Xaa is C or S
FFLVSLSSLKTPVXXAK

SEQ ID NO: 3973 - protein, 20 aa, Artificial Sequence
  GFR-binding peptide
  MOD_RES (14)..(15): Xaa is C or S
FFLVSLSSLKTPAXXAKPVA

SEQ ID NO: 3974 - protein, 15 aa, Artificial Sequence
  GFR-binding peptide
  MOD_RES (14)..(14): Xaa is C or S
FFLVSLSSLKTPAXT

SEQ ID NO: 3975 - protein, 13 aa, Artificial Sequence
  GFR-binding peptide
FFLISLSSLDQPV

SEQ ID NO: 3976 - protein, 19 aa, Artificial Sequence
  GFR-binding peptide
  MOD_RES (14)..(15): Xaa is C or S
FFLMSLSSMKTPTXXPGAS

SEQ ID NO: 3977 - protein, 20 aa, Artificial Sequence
  GFR-binding peptide
  MOD_RES (14)..(15): Xaa is C or S
FFLVSLSSLKTPAXXPKPVH

SEQ ID NO: 3978 - protein, 13 aa, Artificial Sequence
  GFR-binding peptide
FFLISLSSLRAPV

SEQ ID NO: 3979 - protein, 12 aa, Artificial Sequence
  GFR-binding peptide
FFLVSLSSLKTP

SEQ ID NO: 3980 - protein, 15 aa, Artificial Sequence
  GFR-binding peptide
  MOD_RES (14)..(15): Xaa is C or S
FFLISLSSLRTPVXX

SEQ ID NO: 3981 - protein, 13 aa, Artificial Sequence
  GFR-binding peptide
FFLMSLSSLETPV

SEQ ID NO: 3982 - protein, 13 aa, Artificial Sequence
  GFR-binding peptide
FFLVSLSSHHVRS

SEQ ID NO: 3983 - protein, 14 aa, Artificial Sequence
  GFR-binding peptide
  MOD_RES (14)..(14): Xaa is C or S
FFLISLSSLDQPVX

SEQ ID NO: 3984 - protein, 16 aa, Artificial Sequence
  GFR-binding peptide
  MOD_RES (14)..(15): Xaa is C or S
FFLISLSSLKTPVXXA

SEQ ID NO: 3985 - protein, 9 aa, Artificial Sequence
  GFR-binding peptide
FFLVSLSSH

SEQ ID NO: 3986 - protein, 12 aa, Artificial Sequence
  GFR-binding peptide
FFLISLSSLRTP

SEQ ID NO: 3987 - protein, 18 aa, Artificial Sequence
  GFR-binding peptide
  MOD_RES (14)..(15): Xaa is C or S
FFLVSLSSLKTPAXXPKP

SEQ ID NO: 3988 - protein, 17 aa, Artificial Sequence
  GFR-binding peptide
  MOD_RES (14)..(15): Xaa is C or S
FFLISLSSLAQPVXXPA

SEQ ID NO: 3989 - protein, 16 aa, Artificial Sequence
  GFR-binding peptide
  MOD_RES (14)..(15): Xaa is C or S
FFLISLSSMKEPVXXP

SEQ ID NO: 3990 - protein, 15 aa, Artificial Sequence
  GFR-binding peptide
  MOD_RES (14)..(15): Xaa is C or S
FFLVSLSSLKTPVXX

SEQ ID NO: 3991 - protein, 16 aa, Artificial Sequence
  GFR-binding peptide
  MOD_RES (14)..(14): Xaa is C or S
FFLVSLSSLKTPAXTP

SEQ ID NO: 3992 - protein, 15 aa, Artificial Sequence
  GFR-binding peptide
  MOD_RES (14)..(15): Xaa is C or S
FFLISLSSMKEPVXX

SEQ ID NO: 3993 - protein, 14 aa, Artificial Sequence
  GFR-binding peptide
  MOD_RES (14)..(14): Xaa is C or S
FFLISLSSLDQSVX

SEQ ID NO: 3994 - protein, 10 aa, Artificial Sequence
  GFR-binding peptide
FFLMSLSSMK

SEQ ID NO: 3995 - protein, 9 aa, Artificial Sequence
  GFR-binding peptide
FFLVSLSSL

SEQ ID NO: 3996 - protein, 13 aa, Artificial Sequence
  GFR-binding peptide
FFLISLSSLDQSV

SEQ ID NO: 3997 - protein, 11 aa, Artificial Sequence
  GFR-binding peptide
FFLMSLSSTKV

SEQ ID NO: 3998 - protein, 15 aa, Artificial Sequence
  GFR-binding peptide
  MOD_RES (14)..(15): Xaa is C or S
FFLISLSSLKTPVXX

SEQ ID NO: 3999 - protein, 11 aa, Artificial Sequence
  GFR-binding peptide
FFLISLSSLAQ

SEQ ID NO: 4000 - protein, 19 aa, Artificial Sequence
  GFR-binding peptide
  MOD_RES (14)..(15): Xaa is C or S
FFLISLSSLRAPVXXSAPA

SEQ ID NO: 4001 - protein, 15 aa, Artificial Sequence
  GFR-binding peptide
  MOD_RES (14)..(15): Xaa is C or S
FFLVSLSSLKTPAXX

SEQ ID NO: 4002 - protein, 11 aa, Artificial Sequence
  GFR-binding peptide
FFLISLSSMKE

SEQ ID NO: 4003 - protein, 16 aa, Artificial Sequence
  GFR-binding peptide
  MOD_RES (14)..(15): Xaa is C or S
FFLVSLSSLKTPAXXA

SEQ ID NO: 4004 - protein, 17 aa, Artificial Sequence
  GFR-binding peptide
  MOD_RES (14)..(15): Xaa is C or S
FFLMSLSSLETPVXXAK

SEQ ID NO: 4005 - protein, 16 aa, Artificial Sequence
  GFR-binding peptide
  MOD_RES (14)..(15): Xaa is C or S
FFLISLSSLDQPVXXP

SEQ ID NO: 4006 - protein, 18 aa, Artificial Sequence
  GFR-binding peptide
  MOD_RES (14)..(15): Xaa is C or S
FFLISLSSLDQPVXXPSA

SEQ ID NO: 4007 - protein, 17 aa, Artificial Sequence
  GFR-binding peptide
  MOD_RES (14)..(15): Xaa is C or S
FFLISLSSLDQSVXXPS

SEQ ID NO: 4008 - protein, 9 aa, Artificial Sequence
  GFR-binding peptide
FFLISLSSL

SEQ ID NO: 4009 - protein, 20 aa, Artificial Sequence
  GFR-binding peptide
  MOD_RES (14)..(15): Xaa is C or S
FFLVSLSSLKTPVXXAKGVK

SEQ ID NO: 4010 - protein, 19 aa, Artificial Sequence
  GFR-binding peptide
  MOD_RES (14)..(15): Xaa is C or S
FFLMSLSSTKVPAXXTSPV

SEQ ID NO: 4011 - protein, 17 aa, Artificial Sequence
  GFR-binding peptide
  MOD_RES (14)..(15): Xaa is C or S
FFLMSLSSTKVPAXXTS

SEQ ID NO: 4012 - protein, 15 aa, Artificial Sequence
  GFR-binding peptide
  MOD_RES (14)..(15): Xaa is C or S
FFLISLSSLAQPVXX

SEQ ID NO: 4013 - protein, 20 aa, Artificial Sequence
  GFR-binding peptide
  MOD_RES (14)..(15): Xaa is C or S
FFLISLSSLDQSVXXPSASA

SEQ ID NO: 4014 - protein, 18 aa, Artificial Sequence
  GFR-binding peptide
  MOD_RES (14)..(15): Xaa is C or S
FFLVSLSSLKTPVXXAKG

SEQ ID NO: 4015 - protein, 18 aa, Artificial Sequence
  GFR-binding peptide
  MOD_RES (14)..(15): Xaa is C or S
FFLVSLSSLQTPAXXPKP

SEQ ID NO: 4016 - protein, 15 aa, Artificial Sequence
  GFR-binding peptide
  MOD_RES (14)..(15): Xaa is C or S
FFLVSLSSLQTPAXX

SEQ ID NO: 4017 - protein, 12 aa, Artificial Sequence
  GFR-binding peptide
FFLVSLSSLQTP

SEQ ID NO: 4018 - protein, 11 aa, Artificial Sequence
  GFR-binding peptide
FFLISLSSLKT

SEQ ID NO: 4019 - protein, 13 aa, Artificial Sequence
  GFR-binding peptide
FFLMSLSSMKTPT

SEQ ID NO: 4020 - protein, 20 aa, Artificial Sequence
  GFR-binding peptide
  MOD_RES (14)..(15): Xaa is C or S
FFLMSLSSLETPVXXAKPIK

SEQ ID NO: 4021 - protein, 19 aa, Artificial Sequence
  GFR-binding peptide
  MOD_RES (14)..(14): Xaa is C or S
FFLVSLSSLKTPAXTPKTV

SEQ ID NO: 4022 - protein, 17 aa, Artificial Sequence
  GFR-binding peptide
  MOD_RES (14)..(15): Xaa is C or S
FFLMSLSSMKTPTXXPG

SEQ ID NO: 4023 - protein, 20 aa, Artificial Sequence
  GFR-binding peptide
  MOD_RES (14)..(15): Xaa is C or S
FFLISLSSLAQPVXXPAASA

SEQ ID NO: 4024 - protein, 14 aa, Artificial Sequence
  GFR-binding peptide
  MOD_RES (14)..(14): Xaa is C or S
FFLMSLSSEETPVX

SEQ ID NO: 4025 - protein, 16 aa, Artificial Sequence
  GFR-binding peptide
  MOD_RES (14)..(15): Xaa is C or S
FFLISLSSLRTPVXXT

SEQ ID NO: 4026 - protein, 13 aa, Artificial Sequence
  GFR-binding peptide
FFLMSLSSTKVPA

SEQ ID NO: 4027 - protein, 12 aa, Artificial Sequence
  GFR-binding peptide
FFLISLSSLAQP

SEQ ID NO: 4028 - protein, 14 aa, Artificial Sequence
  GFR-binding peptide
  MOD_RES (14)..(14): Xaa is C or S
FFLVSLSSLKTPVX

SEQ ID NO: 4029 - protein, 12 aa, Artificial Sequence
  GFR-binding peptide
FFLISLSSLKTP

SEQ ID NO: 4030 - protein, 16 aa, Artificial Sequence
  GFR-binding peptide
  MOD_RES (14)..(15): Xaa is C or S
FFLVSLSSLKTPVXXA

SEQ ID NO: 4031 - protein, 14 aa, Artificial Sequence
  GFR-binding peptide
  MOD_RES (14)..(14): Xaa is C or S
FFLISLSSLRTPVX

SEQ ID NO: 4032 - protein, 13 aa, Artificial Sequence
  GFR-binding peptide
FFLVSLSSLKTPV

SEQ ID NO: 4033 - protein, 16 aa, Artificial Sequence
  GFR-binding peptide
  MOD_RES (14)..(15): Xaa is C or S
FFLVSLSSLKTPAXXP

SEQ ID NO: 4034 - protein, 12 aa, Artificial Sequence
  GFR-binding peptide
FFLMSLSSTKVP

SEQ ID NO: 4035 - protein, 12 aa, Artificial Sequence
  GFR-binding peptide
FFLISLSSLDQP

SEQ ID NO: 4036 - protein, 11 aa, Artificial Sequence
  GFR-binding peptide
FFLMSLSSEET

SEQ ID NO: 4037 - protein, 13 aa, Artificial Sequence
  GFR-binding peptide
FFLISLSSMKEPV

SEQ ID NO: 4038 - protein, 20 aa, Artificial Sequence
  GFR-binding peptide
  MOD_RES (16)..(16): Xaa is C or S
FFLVSLSSHHVRSPQXKVSS

SEQ ID NO: 4039 - protein, 12 aa, Artificial Sequence
  GFR-binding peptide
FFLVSLSSHHVR

SEQ ID NO: 4040 - protein, 10 aa, Artificial Sequence
  GFR-binding peptide
FFLMSLSSTK

SEQ ID NO: 4041 - protein, 18 aa, Artificial Sequence
  GFR-binding peptide
  MOD_RES (14)..(15): Xaa is C or S
FFLMSLSSTKVPAXXTSP

SEQ ID NO: 4042 - protein, 15 aa, Artificial Sequence
  GFR-binding peptide
  MOD_RES (14)..(15): Xaa is C or S
FFLMSLSSMKTPTXX

SEQ ID NO: 4043 - protein, 16 aa, Artificial Sequence
  GFR-binding peptide
  MOD_RES (14)..(15): Xaa is C or S
FFLISLSSLDQSVXXP

SEQ ID NO: 4044 - protein, 10 aa, Artificial Sequence
  GFR-binding peptide
FFLVSLSSHH

SEQ ID NO: 4045 - protein, 17 aa, Artificial Sequence
  GFR-binding peptide
  MOD_RES (14)..(15): Xaa is C or S
FFLISLSSMKEPVXXPE

SEQ ID NO: 4046 - protein, 15 aa, Artificial Sequence
  GFR-binding peptide
  MOD_RES (14)..(15): Xaa is C or S
FFLMSLSSTKVPAXX

SEQ ID NO: 4047 - protein, 11 aa, Artificial Sequence
  GFR-binding peptide
FFLVSLSSLQT

SEQ ID NO: 4048 - protein, 9 aa, Artificial Sequence
  GFR-binding peptide
FFLISLSSM

SEQ ID NO: 4049 - protein, 14 aa, Artificial Sequence
  GFR-binding peptide
  MOD_RES (14)..(14): Xaa is C or S
FFLVSLSSLQTPAX

SEQ ID NO: 4050 - protein, 11 aa, Artificial Sequence
  GFR-binding peptide
FFLISLSSLDQ

SEQ ID NO: 4051 - protein, 18 aa, Artificial Sequence
  GFR-binding peptide
  MOD_RES (14)..(15): Xaa is C or S
FFLISLSSLKTPVXXAKS

SEQ ID NO: 4052 - protein, 18 aa, Artificial Sequence
  GFR-binding peptide
  MOD_RES (14)..(14): Xaa is C or S
FFLVSLSSLKTPAXTPKT

SEQ ID NO: 4053 - protein, 14 aa, Artificial Sequence
  GFR-binding peptide
  MOD_RES (14)..(14): Xaa is C or S
FFLISLSSLKTPVX

SEQ ID NO: 4054 - protein, 16 aa, Artificial Sequence
  GFR-binding peptide
  MOD_RES (14)..(15): Xaa is C or S
FFLMSLSSTKVPAXXT

SEQ ID NO: 4055 - protein, 20 aa, Artificial Sequence
  GFR-binding peptide
  MOD_RES (14)..(15): Xaa is C or S
FFLVSLSSLQTPAXXPKPVT

SEQ ID NO: 4056 - protein, 18 aa, Artificial Sequence
  GFR-binding peptide
  MOD_RES (14)..(15): Xaa is C or S
FFLMSLSSLETPVXXAKP

SEQ ID NO: 4057 - protein, 18 aa, Artificial Sequence
  GFR-binding peptide
  MOD_RES (14)..(15): Xaa is C or S
FFLISLSSLAQPVXXPAA

SEQ ID NO: 4058 - protein, 19 aa, Artificial Sequence
  GFR-binding peptide
  MOD_RES (14)..(15): Xaa is C or S
FFLVSLSSLQTPAXXPKPV

SEQ ID NO: 4059 - protein, 18 aa, Artificial Sequence
  GFR-binding peptide
  MOD_RES (14)..(15): Xaa is C or S
FFLISLSSLRTPVXXTPP

SEQ ID NO: 4060 - protein, 12 aa, Artificial Sequence
  GFR-binding peptide
FFLMSLSSLETP

SEQ ID NO: 4061 - protein, 18 aa, Artificial Sequence
  GFR-binding peptide
  MOD_RES (14)..(15): Xaa is C or S
FFLISLSSLDQSVXXPSA

SEQ ID NO: 4062 - protein, 17 aa, Artificial Sequence
  GFR-binding peptide
  MOD_RES (14)..(15): Xaa is C or S
FFLVSLSSLQTPAXXPK

SEQ ID NO: 4063 - protein, 14 aa, Artificial Sequence
  GFR-binding peptide
  MOD_RES (14)..(14): Xaa is C or S
FFLMSLSSLETPVX

SEQ ID NO: 4064 - protein, 11 aa, Artificial Sequence
  GFR-binding peptide
QDLSNITIQIM

SEQ ID NO: 4065 - protein, 11 aa, Artificial Sequence
  GFR-binding peptide
TEERPVQMRKI

SEQ ID NO: 4066 - protein, 15 aa, Artificial Sequence
  GFR-binding peptide
  MOD_RES (1)..(2): Xaa is C or S
XXVSQDLRSVKIAKV

SEQ ID NO: 4067 - protein, 12 aa, Artificial Sequence
  GFR-binding peptide
RVHHSNITVQIM

SEQ ID NO: 4068 - protein, 11 aa, Artificial Sequence
  GFR-binding peptide
TQLEPLTVLYY

SEQ ID NO: 4069 - protein, 13 aa, Artificial Sequence
  GFR-binding peptide
VPQDLEPLPIVYY

SEQ ID NO: 4070 - protein, 10 aa, Artificial Sequence
  GFR-binding peptide
KLSNITVQIM

SEQ ID NO: 4071 - protein, 15 aa, Artificial Sequence
  GFR-binding peptide
  MOD_RES (2)..(2): Xaa is C or S
TXAPTKLRSVKVAKV

SEQ ID NO: 4072 - protein, 19 aa, Artificial Sequence
  GFR-binding peptide
  MOD_RES (5)..(6): Xaa is C or S
VPKPXXAPTKLEPLTVLYY

SEQ ID NO: 4073 - protein, 12 aa, Artificial Sequence
  GFR-binding peptide
PTELRSVKMAKV

SEQ ID NO: 4074 - protein, 9 aa, Artificial Sequence
  GFR-binding peptide
LRSVKMAKV

SEQ ID NO: 4075 - protein, 17 aa, Artificial Sequence
  GFR-binding peptide
  MOD_RES (3)..(4): Xaa is C or S
KPXXAPTQLEPLTVLYY

SEQ ID NO: 4076 - protein, 19 aa, Artificial Sequence
  GFR-binding peptide
  MOD_RES (6)..(6): Xaa is C or S
VTKPTXAPTKLRPVQVRKI

SEQ ID NO: 4077 - protein, 18 aa, Artificial Sequence
  GFR-binding peptide
  MOD_RES (5)..(5): Xaa is C or S
TKPTXAPTKLEPLTVLYY

SEQ ID NO: 4078 - protein, 16 aa, Artificial Sequence
  GFR-binding peptide
  MOD_RES (2)..(3): Xaa is C or S
PXXAPTKLEPLPVVYY

SEQ ID NO: 4079 - protein, 16 aa, Artificial Sequence
  GFR-binding peptide
  MOD_RES (3)..(3): Xaa is C or S
PTXAPTKLEPLTVLYY

SEQ ID NO: 4080 - protein, 20 aa, Artificial Sequence
  GFR-binding peptide
  MOD_RES (6)..(7): Xaa is C or S
ASAAPXXVPQALSNITIQIM

SEQ ID NO: 4081 - protein, 19 aa, Artificial Sequence
  GFR-binding peptide
  MOD_RES (5)..(6): Xaa is C or S
VPKPXXAPTQLRSVKVAKV

SEQ ID NO: 4082 - protein, 11 aa, Artificial Sequence
  GFR-binding peptide
TELSNITMQIM

SEQ ID NO: 4083 - protein, 13 aa, Artificial Sequence
  GFR-binding peptide
TQVQLSNITVQIM

SEQ ID NO: 4084 - protein, 19 aa, Artificial Sequence
  GFR-binding peptide
  MOD_RES (6)..(6): Xaa is C or S
DEGLEXVPTEERSVKMAKV

SEQ ID NO: 4085 - protein, 16 aa, Artificial Sequence
  GFR-binding peptide
  MOD_RES (2)..(3): Xaa is C or S
PXXVSQDLRSVKIAKV

SEQ ID NO: 4086 - protein, 9 aa, Artificial Sequence
  GFR-binding peptide
LEPLPVVYY

SEQ ID NO: 4087 - protein, 9 aa, Artificial Sequence
  GFR-binding peptide
LRPVQIRKI

SEQ ID NO: 4088 - protein, 13 aa, Artificial Sequence
  GFR-binding peptide
VPTEERSVKMAKV

SEQ ID NO: 4089 - protein, 10 aa, Artificial Sequence
  GFR-binding peptide
DLEPLPIVYY

SEQ ID NO: 4090 - protein, 13 aa, Artificial Sequence
  GFR-binding peptide
VPTELEPLTMLYY

SEQ ID NO: 4091 - protein, 19 aa, Artificial Sequence
  GFR-binding peptide
  MOD_RES (5)..(6): Xaa is C or S
VPKPXXAPTKLEPLPVVYY

SEQ ID NO: 4092 - protein, 15 aa, Artificial Sequence
  GFR-binding peptide
  MOD_RES (1)..(2): Xaa is C or S
XXVPTELEPLTMLYY

SEQ ID NO: 4093 - protein, 14 aa, Artificial Sequence
  GFR-binding peptide
PSRVHHSNITVQIM

SEQ ID NO: 4094 - protein, 20 aa, Artificial Sequence
  GFR-binding peptide
  MOD_RES (7)..(7): Xaa is C or S
HVTKPTXAPTKLRSVKVAKV

SEQ ID NO: 4095 - protein, 16 aa, Artificial Sequence
  GFR-binding peptide
  MOD_RES (2)..(3): Xaa is C or S
PXXVPQDLEPLPIVYY

SEQ ID NO: 4096 - protein, 11 aa, Artificial Sequence
  GFR-binding peptide
TQLEPLPVVYY

SEQ ID NO: 4097 - protein, 12 aa, Artificial Sequence
  GFR-binding peptide
PTKLRSVKVAKV

SEQ ID NO: 4098 - protein, 13 aa, Artificial Sequence
  GFR-binding peptide
APTKLRSVKVAKV

SEQ ID NO: 4099 - protein, 11 aa, Artificial Sequence
  GFR-binding peptide
VQLEPLTVLYY

SEQ ID NO: 4100 - protein, 17 aa, Artificial Sequence
  GFR-binding peptide
  MOD_RES (3)..(4): Xaa is C or S
KPXXAPTQLEPLPVVYY

SEQ ID NO: 4101 - protein, 17 aa, Artificial Sequence
  GFR-binding peptide
  MOD_RES (3)..(4): Xaa is C or S
APXXVPQALRPVQIRKI

SEQ ID NO: 4102 - protein, 14 aa, Artificial Sequence
  GFR-binding peptide
  MOD_RES (1)..(1): Xaa is C or S
XAPTQLEPLPVVYY

SEQ ID NO: 4103 - protein, 17 aa, Artificial Sequence
  GFR-binding peptide
  MOD_RES (4)..(4): Xaa is C or S
KPTXAPTKLEPLPVVYY

SEQ ID NO: 4104 - protein, 15 aa, Artificial Sequence
  GFR-binding peptide
RPTQVQLEPLTVLYY

SEQ ID NO: 4105 - protein, 18 aa, Artificial Sequence
  GFR-binding peptide
  MOD_RES (4)..(5): Xaa is C or S
PKPXXAPTQLSNITVQIM

SEQ ID NO: 4106 - protein, 14 aa, Artificial Sequence
  GFR-binding peptide
  MOD_RES (1)..(1): Xaa is C or S
XVPTELSNITMQIM

SEQ ID NO: 4107 - protein, 15 aa, Artificial Sequence
  GFR-binding peptide
  MOD_RES (2)..(2): Xaa is C or S
EXVPTEERSVKMAKV

SEQ ID NO: 4108 - protein, 13 aa, Artificial Sequence
  GFR-binding peptide
VSQDLRSVKIAKV

SEQ ID NO: 4109 - protein, 14 aa, Artificial Sequence
  GFR-binding peptide
  MOD_RES (1)..(1): Xaa is C or S
XVPTEERPVQMRKI

SEQ ID NO: 4110 - protein, 16 aa, Artificial Sequence
  GFR-binding peptide
  MOD_RES (3)..(3): Xaa is C or S
PTXAPTKLEPLPVVYY

SEQ ID NO: 4111 - protein, 17 aa, Artificial Sequence
  GFR-binding peptide
  MOD_RES (3)..(4): Xaa is C or S
SPXXVSQDLEPLPIVYY

SEQ ID NO: 4112 - protein, 16 aa, Artificial Sequence
  GFR-binding peptide
  MOD_RES (2)..(3): Xaa is C or S
PXXAPTKLEPLTVLYY

SEQ ID NO: 4113 - protein, 15 aa, Artificial Sequence
  GFR-binding peptide
QPSRVHHSNITVQIM

SEQ ID NO: 4114 - protein, 14 aa, Artificial Sequence
  GFR-binding peptide
  MOD_RES (1)..(1): Xaa is C or S
XVPQDLSNITIQIM

SEQ ID NO: 4115 - protein, 20 aa, Artificial Sequence
  GFR-binding peptide
  MOD_RES (6)..(7): Xaa is C or S
KIPKAXXVPTELEPLTMLYY

SEQ ID NO: 4116 - protein, 14 aa, Artificial Sequence
  GFR-binding peptide
  MOD_RES (1)..(1): Xaa is C or S
XVPTEEEPLTMLYY

SEQ ID NO: 4117 - protein, 18 aa, Artificial Sequence
  GFR-binding peptide
  MOD_RES (5)..(5): Xaa is C or S
TKPTXAPTKLRPVQVRKI

SEQ ID NO: 4118 - protein, 14 aa, Artificial Sequence
  GFR-binding peptide
  MOD_RES (1)..(1): Xaa is C or S
XVPTELRPVQMRKI

SEQ ID NO: 4119 - protein, 15 aa, Artificial Sequence
  GFR-binding peptide
  MOD_RES (1)..(2): Xaa is C or S
XXAPTKLEPLPVVYY

SEQ ID NO: 4120 - protein, 13 aa, Artificial Sequence
  GFR-binding peptide
APTKLEPLPVVYY

SEQ ID NO: 4121 - protein, 17 aa, Artificial Sequence
  GFR-binding peptide
  MOD_RES (3)..(4): Xaa is C or S
KPXXAPTQLRPVQVRKI

SEQ ID NO: 4122 - protein, 20 aa, Artificial Sequence
  GFR-binding peptide
  MOD_RES (6)..(7): Xaa is C or S
SIPKAXXVPTELEPLPMVYY

SEQ ID NO: 4123 - protein, 17 aa, Artificial Sequence
  GFR-binding peptide
  MOD_RES (3)..(4): Xaa is C or S
KPXXAPTKLRPVQVRKI

SEQ ID NO: 4124 - protein, 17 aa, Artificial Sequence
  GFR-binding peptide
  MOD_RES (2)..(2): Xaa is C or S
KXQPSRVHHEPLPVVYY

SEQ ID NO: 4125 - protein, 20 aa, Artificial Sequence
  GFR-binding peptide
  MOD_RES (6)..(7): Xaa is C or S
ASASPXXVPQDLRPVQIRKI

SEQ ID NO: 4126 - protein, 11 aa, Artificial Sequence
  GFR-binding peptide
TQLRPVQVRKI

SEQ ID NO: 4127 - protein, 14 aa, Artificial Sequence
  GFR-binding peptide
PTQVQLSNITVQIM

SEQ ID NO: 4128 - protein, 17 aa, Artificial Sequence
  GFR-binding peptide
  MOD_RES (3)..(4): Xaa is C or S
APXXVPQALSNITIQIM

SEQ ID NO: 4129 - protein, 14 aa, Artificial Sequence
  GFR-binding peptide
  MOD_RES (1)..(1): Xaa is C or S
XAPTKLEPLTVLYY

SEQ ID NO: 4130 - protein, 16 aa, Artificial Sequence
  GFR-binding peptide
  MOD_RES (2)..(3): Xaa is C or S
PXXVPQALRSVKIAKV

SEQ ID NO: 4131 - protein, 18 aa, Artificial Sequence
  GFR-binding peptide
  MOD_RES (4)..(5): Xaa is C or S
PKAXXVPTELSNITMQIM

SEQ ID NO: 4132 - protein, 17 aa, Artificial Sequence
  GFR-binding peptide
  MOD_RES (4)..(4): Xaa is C or S
KPTXAPTKLEPLTVLYY

SEQ ID NO: 4133 - protein, 17 aa, Artificial Sequence
  GFR-binding peptide
  MOD_RES (3)..(4): Xaa is C or S
KAXXVPTELSNITMQIM

SEQ ID NO: 4134 - protein, 12 aa, Artificial Sequence
  GFR-binding peptide
PTQLSNITVQIM

SEQ ID NO: 4135 - protein, 19 aa, Artificial Sequence
  GFR-binding peptide
  MOD_RES (6)..(6): Xaa is C or S
VTKPTXAPTKLEPLTVLYY

SEQ ID NO: 4136 - protein, 17 aa, Artificial Sequence
  GFR-binding peptide
  MOD_RES (3)..(4): Xaa is C or S
SPXXVSQDLRSVKIAKV

SEQ ID NO: 4137 - protein, 15 aa, Artificial Sequence
  GFR-binding peptide
  MOD_RES (2)..(2): Xaa is C or S
TXAPTKLEPLPVVYY

SEQ ID NO: 4138 - protein, 20 aa, Artificial Sequence
  GFR-binding peptide
  MOD_RES (6)..(7): Xaa is C or S
ASAAPXXVPQALRPVQIRKI

SEQ ID NO: 4139 - protein, 13 aa, Artificial Sequence
  GFR-binding peptide
VPTELRPVQMRKI

SEQ ID NO: 4140 - protein, 16 aa, Artificial Sequence
  GFR-binding peptide
  MOD_RES (2)..(3): Xaa is C or S
AXXVPTELEPLTMLYY

SEQ ID NO: 4141 - protein, 15 aa, Artificial Sequence
  GFR-binding peptide
  MOD_RES (1)..(2): Xaa is C or S
XXAPTKLRSVKVAKV

SEQ ID NO: 4142 - protein, 14 aa, Artificial Sequence
  GFR-binding peptide
  MOD_RES (1)..(1): Xaa is C or S
XAPTQLEPLTVLYY

SEQ ID NO: 4143 - protein, 15 aa, Artificial Sequence
  GFR-binding peptide
  MOD_RES (1)..(2): Xaa is C or S
XXVPQDLEPLPIVYY

SEQ ID NO: 4144 - protein, 10 aa, Artificial Sequence
  GFR-binding peptide
ELSNITMQIM

SEQ ID NO: 4145 - protein, 19 aa, Artificial Sequence
  GFR-binding peptide
  MOD_RES (5)..(6): Xaa is C or S
SASPXXVSQDLRSVKIAKV

SEQ ID NO: 4146 - protein, 20 aa, Artificial Sequence
  GFR-binding peptide
  MOD_RES (7)..(7): Xaa is C or S
HVTKPTXAPTKLEPLPVVYY

SEQ ID NO: 4147 - protein, 14 aa, Artificial Sequence
  GFR-binding peptide
  MOD_RES (1)..(1): Xaa is C or S
XVPTEEEPLPMVYY

SEQ ID NO: 4148 - protein, 19 aa, Artificial Sequence
  GFR-binding peptide
  MOD_RES (5)..(6): Xaa is C or S
IPKAXXVPTELRSVKMAKV

SEQ ID NO: 4149 - protein, 19 aa, Artificial Sequence
  GFR-binding peptide
  MOD_RES (5)..(6): Xaa is C or S
IPKAXXVPTELEPLTMLYY

SEQ ID NO: 4150 - protein, 17 aa, Artificial Sequence
  GFR-binding peptide
  MOD_RES (3)..(4): Xaa is C or S
KAXXVPTELEPLTMLYY

SEQ ID NO: 4151 - protein, 20 aa, Artificial Sequence
  GFR-binding peptide
  MOD_RES (7)..(7): Xaa is C or S
NDEGLEXVPTEEEPLTMLYY

SEQ ID NO: 4152 - protein, 14 aa, Artificial Sequence
  GFR-binding peptide
  MOD_RES (1)..(1): Xaa is C or S
XVPQALRSVKIAKV

SEQ ID NO: 4153 - protein, 15 aa, Artificial Sequence
  GFR-binding peptide
  MOD_RES (1)..(2): Xaa is C or S
XXVPTELRPVQMRKI

SEQ ID NO: 4154 - protein, 9 aa, Artificial Sequence
  GFR-binding peptide
ERSVKMAKV

SEQ ID NO: 4155 - protein, 18 aa, Artificial Sequence
  GFR-binding peptide
  MOD_RES (3)..(3): Xaa is C or S
VKXQPSRVHHRPVQVRKI

SEQ ID NO: 4156 - protein, 17 aa, Artificial Sequence
  GFR-binding peptide
  MOD_RES (3)..(4): Xaa is C or S
APXXVPQALEPLTILYY

SEQ ID NO: 4157 - protein, 10 aa, Artificial Sequence
  GFR-binding peptide
QLEPLTVLYY

SEQ ID NO: 4158 - protein, 17 aa, Artificial Sequence
  GFR-binding peptide
  MOD_RES (2)..(2): Xaa is C or S
KXQPSRVHHRPVQVRKI

SEQ ID NO: 4159 - protein, 14 aa, Artificial Sequence
  GFR-binding peptide
  MOD_RES (1)..(1): Xaa is C or S
XVSQDLRPVQIRKI

SEQ ID NO: 4160 - protein, 19 aa, Artificial Sequence
  GFR-binding peptide
  MOD_RES (5)..(6): Xaa is C or S
SASPXXVPQDLEPLPIVYY

SEQ ID NO: 4161 - protein, 15 aa, Artificial Sequence
  GFR-binding peptide
  MOD_RES (2)..(2): Xaa is C or S
EXVPTEEEPLTMLYY

SEQ ID NO: 4162 - protein, 16 aa, Artificial Sequence
  GFR-binding peptide
  MOD_RES (2)..(3): Xaa is C or S
AXXVPTELRSVKMAKV

SEQ ID NO: 4163 - protein, 17 aa, Artificial Sequence
  GFR-binding peptide
  MOD_RES (4)..(4): Xaa is C or S
GLEXVPTEERSVKMAKV

SEQ ID NO: 4164 - protein, 14 aa, Artificial Sequence
  GFR-binding peptide
  MOD_RES (1)..(1): Xaa is C or S
XAPTKLSNITVQIM

SEQ ID NO: 4165 - protein, 11 aa, Artificial Sequence
  GFR-binding peptide
QALEPLTILYY

SEQ ID NO: 4166 - protein, 13 aa, Artificial Sequence
  GFR-binding peptide
APTQLRSVKVAKV

SEQ ID NO: 4167 - protein, 15 aa, Artificial Sequence
  GFR-binding peptide
  MOD_RES (1)..(2): Xaa is C or S
XXAPTQLRSVKVAKV

SEQ ID NO: 4168 - protein, 16 aa, Artificial Sequence
  GFR-binding peptide
  MOD_RES (1)..(1): Xaa is C or S
XQPSRVHHRPVQVRKI

SEQ ID NO: 4169 - protein, 16 aa, Artificial Sequence
  GFR-binding peptide
  MOD_RES (1)..(1): Xaa is C or S
XRPTQVQLEPLPVVYY

SEQ ID NO: 4170 - protein, 9 aa, Artificial Sequence
  GFR-binding peptide
LEPLPMVYY

SEQ ID NO: 4171 - protein, 14 aa, Artificial Sequence
  GFR-binding peptide
  MOD_RES (1)..(1): Xaa is C or S
XVSQDLEPLPIVYY

SEQ ID NO: 4172 - protein, 17 aa, Artificial Sequence
  GFR-binding peptide
  MOD_RES (3)..(4): Xaa is C or S
SPXXVPQDLSNITIQIM

SEQ ID NO: 4173 - protein, 10 aa, Artificial Sequence
  GFR-binding peptide
DLRPVQIRKI

SEQ ID NO: 4174 - protein, 10 aa, Artificial Sequence
  GFR-binding peptide
EERPVQMRKI

SEQ ID NO: 4175 - protein, 13 aa, Artificial Sequence
  GFR-binding peptide
VPTELEPLPMVYY

SEQ ID NO: 4176 - protein, 15 aa, Artificial Sequence
  GFR-binding peptide
  MOD_RES (1)..(2): Xaa is C or S
XXVPTELEPLPMVYY

SEQ ID NO: 4177 - protein, 9 aa, Artificial Sequence
  GFR-binding peptide
LEPLTVLYY

SEQ ID NO: 4178 - protein, 12 aa, Artificial Sequence
  GFR-binding peptide
QVQLEPLTVLYY

SEQ ID NO: 4179 - protein, 11 aa, Artificial Sequence
  GFR-binding peptide
TKLSNITVQIM

SEQ ID NO: 4180 - protein, 13 aa, Artificial Sequence
  GFR-binding peptide
VPQDLRPVQIRKI

SEQ ID NO: 4181 - protein, 12 aa, Artificial Sequence
  GFR-binding peptide
QVQLSNITVQIM

SEQ ID NO: 4182 - protein, 12 aa, Artificial Sequence
  GFR-binding peptide
PQDLRSVKIAKV

SEQ ID NO: 4183 - protein, 15 aa, Artificial Sequence
  GFR-binding peptide
  MOD_RES (1)..(2): Xaa is C or S
XXVPQDLRPVQIRKI

SEQ ID NO: 4184 - protein, 20 aa, Artificial Sequence
  GFR-binding peptide
  MOD_RES (6)..(7): Xaa is C or S
KIPKAXXVPTELRSVKMAKV

SEQ ID NO: 4185 - protein, 15 aa, Artificial Sequence
  GFR-binding peptide
  MOD_RES (1)..(2): Xaa is C or S
XXVPTELSNITMQIM

SEQ ID NO: 4186 - protein, 13 aa, Artificial Sequence
  GFR-binding peptide
VPTEEEPLTMLYY

SEQ ID NO: 4187 - protein, 14 aa, Artificial Sequence
  GFR-binding peptide
  MOD_RES (1)..(1): Xaa is C or S
XVPTEERSVKMAKV

SEQ ID NO: 4188 - protein, 12 aa, Artificial Sequence
  GFR-binding peptide
SQDLRSVKIAKV

SEQ ID NO: 4189 - protein, 19 aa, Artificial Sequence
  GFR-binding peptide
  MOD_RES (6)..(6): Xaa is C or S
DEGLEXVPTEEEPLTMLYY

SEQ ID NO: 4190 - protein, 16 aa, Artificial Sequence
  GFR-binding peptide
  MOD_RES (2)..(3): Xaa is C or S
PXXVPQDLRSVKIAKV

SEQ ID NO: 4191 - protein, 13 aa, Artificial Sequence
  GFR-binding peptide
VSQDLEPLPIVYY

SEQ ID NO: 4192 - protein, 14 aa, Artificial Sequence
  GFR-binding peptide
PTQVQLEPLPVVYY

SEQ ID NO: 4193 - protein, 17 aa, Artificial Sequence
  GFR-binding peptide
  MOD_RES (3)..(4): Xaa is C or S
KPXXAPTQLRSVKVAKV

SEQ ID NO: 4194 - protein, 15 aa, Artificial Sequence
  GFR-binding peptide
  MOD_RES (1)..(2): Xaa is C or S
XXVPQDLRSVKIAKV

SEQ ID NO: 4195 - protein, 15 aa, Artificial Sequence
  GFR-binding peptide
RPTQVQLRSVKVAKV

SEQ ID NO: 4196 - protein, 19 aa, Artificial Sequence
  GFR-binding peptide
  MOD_RES (5)..(6): Xaa is C or S
VPKPXXAPTQLEPLTVLYY

SEQ ID NO: 4197 - protein, 14 aa, Artificial Sequence
  GFR-binding peptide
  MOD_RES (1)..(1): Xaa is C or S
XVPTELEPLTMLYY

SEQ ID NO: 4198 - protein, 19 aa, Artificial Sequence
  GFR-binding peptide
  MOD_RES (5)..(6): Xaa is C or S
IPKAXXVPTELRPVQMRKI

SEQ ID NO: 4199 - protein, 18 aa, Artificial Sequence
  GFR-binding peptide
  MOD_RES (3)..(3): Xaa is C or S
VKXQPSRVHHEPLPVVYY

SEQ ID NO: 4200 - protein, 15 aa, Artificial Sequence
  GFR-binding peptide
QPSRVHHRPVQVRKI

SEQ ID NO: 4201 - protein, 16 aa, Artificial Sequence
  GFR-binding peptide
  MOD_RES (1)..(1): Xaa is C or S
XQPSRVHHEPLPVVYY

SEQ ID NO: 4202 - protein, 19 aa, Artificial Sequence
  GFR-binding peptide
  MOD_RES (5)..(6): Xaa is C or S
SASPXXVSQDLSNITIQIM

SEQ ID NO: 4203 - protein, 17 aa, Artificial Sequence
  GFR-binding peptide
  MOD_RES (4)..(4): Xaa is C or S
GLEXVPTEERPVQMRKI

SEQ ID NO: 4204 - protein, 20 aa, Artificial Sequence
  GFR-binding peptide
  MOD_RES (6)..(7): Xaa is C or S
YVPKPXXAPTKLEPLTVLYY

SEQ ID NO: 4205 - protein, 14 aa, Artificial Sequence
  GFR-binding peptide
  MOD_RES (1)..(1): Xaa is C or S
XVPTELEPLPMVYY

SEQ ID NO: 4206 - protein, 12 aa, Artificial Sequence
  GFR-binding peptide
RVHHEPLTVLYY

SEQ ID NO: 4207 - protein, 18 aa, Artificial Sequence
  GFR-binding peptide
  MOD_RES (5)..(5): Xaa is C or S
TKPTXAPTKLRSVKVAKV

SEQ ID NO: 4208 - protein, 17 aa, Artificial Sequence
  GFR-binding peptide
  MOD_RES (3)..(4): Xaa is C or S
SPXXVSQDLRPVQIRKI

SEQ ID NO: 4209 - protein, 10 aa, Artificial Sequence
  GFR-binding peptide
KLRPVQVRKI

SEQ ID NO: 4210 - protein, 19 aa, Artificial Sequence
  GFR-binding peptide
  MOD_RES (5)..(6): Xaa is C or S
SASPXXVPQDLRPVQIRKI

SEQ ID NO: 4211 - protein, 17 aa, Artificial Sequence
  GFR-binding peptide
  MOD_RES (3)..(4): Xaa is C or S
SPXXVPQDLEPLPIVYY

SEQ ID NO: 4212 - protein, 20 aa, Artificial Sequence
  GFR-binding peptide
  MOD_RES (7)..(7): Xaa is C or S
NDEGLEXVPTEERSVKMAKV

SEQ ID NO: 4213 - protein, 16 aa, Artificial Sequence
  GFR-binding peptide
  MOD_RES (3)..(3): Xaa is C or S
LEXVPTEERPVQMRKI

SEQ ID NO: 4214 - protein, 11 aa, Artificial Sequence
  GFR-binding peptide
VHHEPLPVVYY

SEQ ID NO: 4215 - protein, 16 aa, Artificial Sequence
  GFR-binding peptide
  MOD_RES (3)..(3): Xaa is C or S
PTXAPTKLRSVKVAKV

SEQ ID NO: 4216 - protein, 18 aa, Artificial Sequence
  GFR-binding peptide
  MOD_RES (3)..(3): Xaa is C or S
VQXRPTQVQLRSVKVAKV

SEQ ID NO: 4217 - protein, 11 aa, Artificial Sequence
  GFR-binding peptide
QDLRPVQIRKI

SEQ ID NO: 4218 - protein, 12 aa, Artificial Sequence
  GFR-binding peptide
RVHHRPVQVRKI

SEQ ID NO: 4219 - protein, 16 aa, Artificial Sequence
  GFR-binding peptide
  MOD_RES (2)..(3): Xaa is C or S
PXXVSQDLEPLPIVYY

SEQ ID NO: 4220 - protein, 20 aa, Artificial Sequence
  GFR-binding peptide
  MOD_RES (6)..(7): Xaa is C or S
SIPKAXXVPTELEPLTMLYY

SEQ ID NO: 4221 - protein, 11 aa, Artificial Sequence
  GFR-binding peptide
TEEEPLPMVYY

SEQ ID NO: 4222 - protein, 10 aa, Artificial Sequence
  GFR-binding peptide
HHEPLTVLYY

SEQ ID NO: 4223 - protein, 11 aa, Artificial Sequence
  GFR-binding peptide
TQLSNITVQIM

SEQ ID NO: 4224 - protein, 17 aa, Artificial Sequence
  GFR-binding peptide
  MOD_RES (4)..(4): Xaa is C or S
GLEXVPTEEEPLTMLYY

SEQ ID NO: 4225 - protein, 18 aa, Artificial Sequence
  GFR-binding peptide
  MOD_RES (5)..(5): Xaa is C or S
EGLEXVPTEEEPLTMLYY

SEQ ID NO: 4226 - protein, 18 aa, Artificial Sequence
  GFR-binding peptide
  MOD_RES (4)..(5): Xaa is C or S
PKPXXAPTKLRSVKVAKV

SEQ ID NO: 4227 - protein, 15 aa, Artificial Sequence
  GFR-binding peptide
QPSRVHHEPLTVLYY

SEQ ID NO: 4228 - protein, 9 aa, Artificial Sequence
  GFR-binding peptide
LEPLTMLYY

SEQ ID NO: 4229 - protein, 16 aa, Artificial Sequence
  GFR-binding peptide
  MOD_RES (2)..(3): Xaa is C or S
PXXAPTKLRPVQVRKI

SEQ ID NO: 4230 - protein, 13 aa, Artificial Sequence
  GFR-binding peptide
VPQDLRSVKIAKV

SEQ ID NO: 4231 - protein, 10 aa, Artificial Sequence
  GFR-binding peptide
KLEPLTVLYY

SEQ ID NO: 4232 - protein, 15 aa, Artificial Sequence
  GFR-binding peptide
  MOD_RES (1)..(2): Xaa is C or S
XXVSQDLEPLPIVYY

SEQ ID NO: 4233 - protein, 10 aa, Artificial Sequence
  GFR-binding peptide
DLRSVKIAKV

SEQ ID NO: 4234 - protein, 12 aa, Artificial Sequence
  GFR-binding peptide
PTELEPLTMLYY

SEQ ID NO: 4235 - protein, 20 aa, Artificial Sequence
  GFR-binding peptide
  MOD_RES (6)..(7): Xaa is C or S
TVPKPXXAPTQLEPLTVLYY

SEQ ID NO: 4236 - protein, 13 aa, Artificial Sequence
  GFR-binding peptide
SRVHHSNITVQIM

SEQ ID NO: 4237 - protein, 11 aa, Artificial Sequence
  GFR-binding peptide
QALRSVKIAKV

SEQ ID NO: 4238 - protein, 20 aa, Artificial Sequence
  GFR-binding peptide
  MOD_RES (6)..(7): Xaa is C or S
TVPKPXXAPTQLSNITVQIM

SEQ ID NO: 4239 - protein, 12 aa, Artificial Sequence
  GFR-binding peptide
QVQLRSVKVAKV

SEQ ID NO: 4240 - protein, 12 aa, Artificial Sequence
  GFR-binding peptide
PTKLEPLPVVYY

SEQ ID NO: 4241 - protein, 10 aa, Artificial Sequence
  GFR-binding peptide
QLRSVKVAKV

SEQ ID NO: 4242 - protein, 20 aa, Artificial Sequence
  GFR-binding peptide
  MOD_RES (5)..(5): Xaa is C or S
SSVKXQPSRVHHSNITVQIM

SEQ ID NO: 4243 - protein, 12 aa, Artificial Sequence
  GFR-binding peptide
PTELRPVQMRKI

SEQ ID NO: 4244 - protein, 20 aa, Artificial Sequence
  GFR-binding peptide
  MOD_RES (7)..(7): Xaa is C or S
NDEGLEXVPTEEEPLPMVYY

SEQ ID NO: 4245 - protein, 19 aa, Artificial Sequence
  GFR-binding peptide
  MOD_RES (5)..(6): Xaa is C or S
SAAPXXVPQALEPLTILYY

SEQ ID NO: 4246 - protein, 19 aa, Artificial Sequence
  GFR-binding peptide
  MOD_RES (6)..(6): Xaa is C or S
DEGLEXVPTEERPVQMRKI

SEQ ID NO: 4247 - protein, 10 aa, Artificial Sequence
  GFR-binding peptide
KLEPLPVVYY

SEQ ID NO: 4248 - protein, 13 aa, Artificial Sequence
  GFR-binding peptide
VPTEERPVQMRKI

SEQ ID NO: 4249 - protein, 18 aa, Artificial Sequence
  GFR-binding peptide
  MOD_RES (3)..(3): Xaa is C or S
VKXQPSRVHHSNITVQIM

SEQ ID NO: 4250 - protein, 16 aa, Artificial Sequence
  GFR-binding peptide
  MOD_RES (2)..(3): Xaa is C or S
PXXAPTKLRSVKVAKV

SEQ ID NO: 4251 - protein, 18 aa, Artificial Sequence
  GFR-binding peptide
  MOD_RES (5)..(5): Xaa is C or S
EGLEXVPTEEEPLPMVYY

SEQ ID NO: 4252 - protein, 17 aa, Artificial Sequence
  GFR-binding peptide
  MOD_RES (3)..(4): Xaa is C or S
SPXXVSQDLSNITIQIM

SEQ ID NO: 4253 - protein, 12 aa, Artificial Sequence
  GFR-binding peptide
RVHHEPLPVVYY

SEQ ID NO: 4254 - protein, 16 aa, Artificial Sequence
  GFR-binding peptide
  MOD_RES (3)..(3): Xaa is C or S
PTXAPTKLRPVQVRKI

SEQ ID NO: 4255 - protein, 14 aa, Artificial Sequence
  GFR-binding peptide
PSRVHHEPLTVLYY

SEQ ID NO: 4256 - protein, 15 aa, Artificial Sequence
  GFR-binding peptide
QPSRVHHEPLPVVYY

SEQ ID NO: 4257 - protein, 10 aa, Artificial Sequence
  GFR-binding peptide
QLEPLPVVYY

SEQ ID NO: 4258 - protein, 16 aa, Artificial Sequence
  GFR-binding peptide
  MOD_RES (2)..(3): Xaa is C or S
PXXAPTQLRSVKVAKV

SEQ ID NO: 4259 - protein, 15 aa, Artificial Sequence
  GFR-binding peptide
  MOD_RES (1)..(2): Xaa is C or S
XXVPQALRSVKIAKV

SEQ ID NO: 4260 - protein, 16 aa, Artificial Sequence
  GFR-binding peptide
  MOD_RES (1)..(1): Xaa is C or S
XRPTQVQLRSVKVAKV

SEQ ID NO: 4261 - protein, 13 aa, Artificial Sequence
  GFR-binding peptide
VPTELSNITMQIM

SEQ ID NO: 4262 - protein, 14 aa, Artificial Sequence
  GFR-binding peptide
PTQVQLRSVKVAKV

SEQ ID NO: 4263 - protein, 13 aa, Artificial Sequence
  GFR-binding peptide
SRVHHRPVQVRKI

SEQ ID NO: 4264 - protein, 10 aa, Artificial Sequence
  GFR-binding peptide
ALRSVKIAKV

SEQ ID NO: 4265 - protein, 12 aa, Artificial Sequence
  GFR-binding peptide
PTELEPLPMVYY

SEQ ID NO: 4266 - protein, 18 aa, Artificial Sequence
  GFR-binding peptide
  MOD_RES (3)..(3): Xaa is C or S
VKXQPSRVHHEPLTVLYY

SEQ ID NO: 4267 - protein, 15 aa, Artificial Sequence
  GFR-binding peptide
  MOD_RES (1)..(2): Xaa is C or S
XXVSQDLRPVQIRKI

SEQ ID NO: 4268 - protein, 12 aa, Artificial Sequence
  GFR-binding peptide
PTKLSNITVQIM

SEQ ID NO: 4269 - protein, 20 aa, Artificial Sequence
  GFR-binding peptide
  MOD_RES (5)..(5): Xaa is C or S
SSVKXQPSRVHHEPLPVVYY

SEQ ID NO: 4270 - protein, 16 aa, Artificial Sequence
  GFR-binding peptide
  MOD_RES (2)..(3): Xaa is C or S
PXXVPQDLRPVQIRKI

SEQ ID NO: 4271 - protein, 12 aa, Artificial Sequence
  GFR-binding peptide
QVQLEPLPVVYY

SEQ ID NO: 4272 - protein, 17 aa, Artificial Sequence
  GFR-binding peptide
  MOD_RES (2)..(2): Xaa is C or S
QXRPTQVQLSNITVQIM

SEQ ID NO: 4273 - protein, 11 aa, Artificial Sequence
  GFR-binding peptide
TEEEPLTMLYY

SEQ ID NO: 4274 - protein, 18 aa, Artificial Sequence
  GFR-binding peptide
  MOD_RES (5)..(5): Xaa is C or S
EGLEXVPTEERPVQMRKI

SEQ ID NO: 4275 - protein, 12 aa, Artificial Sequence
  GFR-binding peptide
PTQLRPVQVRKI

SEQ ID NO: 4276 - protein, 11 aa, Artificial Sequence
  GFR-binding peptide
QALRPVQIRKI

SEQ ID NO: 4277 - protein, 11 aa, Artificial Sequence
  GFR-binding peptide
VHHRPVQVRKI

SEQ ID NO: 4278 - protein, 20 aa, Artificial Sequence
  GFR-binding peptide
  MOD_RES (6)..(7): Xaa is C or S
ASASPXXVPQDLSNITIQIM

SEQ ID NO: 4279 - protein, 14 aa, Artificial Sequence
  GFR-binding peptide
  MOD_RES (1)..(1): Xaa is C or S
XVSQDLRSVKIAKV

SEQ ID NO: 4280 - protein, 13 aa, Artificial Sequence
  GFR-binding peptide
VSQDLRPVQIRKI

SEQ ID NO: 4281 - protein, 19 aa, Artificial Sequence
  GFR-binding peptide
  MOD_RES (5)..(6): Xaa is C or S
SAAPXXVPQALSNITIQIM

SEQ ID NO: 4282 - protein, 19 aa, Artificial Sequence
  GFR-binding peptide
  MOD_RES (5)..(6): Xaa is C or S
IPKAXXVPTELEPLPMVYY

SEQ ID NO: 4283 - protein, 12 aa, Artificial Sequence
  GFR-binding peptide
PTEERSVKMAKV

SEQ ID NO: 4284 - protein, 12 aa, Artificial Sequence
  GFR-binding peptide
PTKLEPLTVLYY

SEQ ID NO: 4285 - protein, 19 aa, Artificial Sequence
  GFR-binding peptide
  MOD_RES (6)..(6): Xaa is C or S
DEGLEXVPTEEEPLPMVYY

SEQ ID NO: 4286 - protein, 17 aa, Artificial Sequence
  GFR-binding peptide
  MOD_RES (3)..(4): Xaa is C or S
SPXXVPQDLRPVQIRKI

SEQ ID NO: 4287 - protein, 20 aa, Artificial Sequence
  GFR-binding peptide
  MOD_RES (7)..(7): Xaa is C or S
NDEGLEXVPTEERPVQMRKI

SEQ ID NO: 4288 - protein, 18 aa, Artificial Sequence
  GFR-binding peptide
  MOD_RES (4)..(5): Xaa is C or S
AAPXXVPQALRSVKIAKV

SEQ ID NO: 4289 - protein, 13 aa, Artificial Sequence
  GFR-binding peptide
VPTEEEPLPMVYY

SEQ ID NO: 4290 - protein, 9 aa, Artificial Sequence
  GFR-binding peptide
ERPVQMRKI

SEQ ID NO: 4291 - protein, 13 aa, Artificial Sequence
  GFR-binding peptide
VPQALRSVKIAKV

SEQ ID NO: 4292 - protein, 15 aa, Artificial Sequence
  GFR-binding peptide
  MOD_RES (2)..(2): Xaa is C or S
TXAPTKLEPLTVLYY

SEQ ID NO: 4293 - protein, 10 aa, Artificial Sequence
  GFR-binding peptide
ELEPLPMVYY

SEQ ID NO: 4294 - protein, 16 aa, Artificial Sequence
  GFR-binding peptide
  MOD_RES (3)..(3): Xaa is C or S
LEXVPTEERSVKMAKV

SEQ ID NO: 4295 - protein, 13 aa, Artificial Sequence
  GFR-binding peptide
SRVHHEPLPVVYY

SEQ ID NO: 4296 - protein, 19 aa, Artificial Sequence
  GFR-binding peptide
  MOD_RES (5)..(6): Xaa is C or S
SASPXXVSQDLEPLPIVYY

SEQ ID NO: 4297 - protein, 10 aa, Artificial Sequence
  GFR-binding peptide
ELRPVQMRKI

SEQ ID NO: 4298 - protein, 16 aa, Artificial Sequence
  GFR-binding peptide
  MOD_RES (1)..(1): Xaa is C or S
XQPSRVHHEPLTVLYY

SEQ ID NO: 4299 - protein, 9 aa, Artificial Sequence
  GFR-binding peptide
EEPLPMVYY

SEQ ID NO: 4300 - protein, 16 aa, Artificial Sequence
  GFR-binding peptide
  MOD_RES (1)..(1): Xaa is C or S
XQPSRVHHSNITVQIM

SEQ ID NO: 4301 - protein, 19 aa, Artificial Sequence
  GFR-binding peptide
  MOD_RES (5)..(6): Xaa is C or S
SASPXXVPQDLRSVKIAKV

SEQ ID NO: 4302 - protein, 20 aa, Artificial Sequence
  GFR-binding peptide
  MOD_RES (6)..(7): Xaa is C or S
YVPKPXXAPTKLEPLPVVYY

SEQ ID NO: 4303 - protein, 17 aa, Artificial Sequence
  GFR-binding peptide
  MOD_RES (4)..(4): Xaa is C or S
GLEXVPTEEEPLPMVYY

SEQ ID NO: 4304 - protein, 13 aa, Artificial Sequence
  GFR-binding peptide
TQVQLRSVKVAKV

SEQ ID NO: 4305 - protein, 10 aa, Artificial Sequence
  GFR-binding peptide
ALRPVQIRKI

SEQ ID NO: 4306 - protein, 16 aa, Artificial Sequence
  GFR-binding peptide
  MOD_RES (2)..(3): Xaa is C or S
PXXVPQALRPVQIRKI

SEQ ID NO: 4307 - protein, 20 aa, Artificial Sequence
  GFR-binding peptide
  MOD_RES (6)..(7): Xaa is C or S
SIPKAXXVPTELSNITMQIM

SEQ ID NO: 4308 - protein, 12 aa, Artificial Sequence
  GFR-binding peptide
PTQLEPLPVVYY

SEQ ID NO: 4309 - protein, 12 aa, Artificial Sequence
  GFR-binding peptide
PTELSNITMQIM

SEQ ID NO: 4310 - protein, 20 aa, Artificial Sequence
  GFR-binding peptide
  MOD_RES (6)..(7): Xaa is C or S
ASASPXXVPQDLRSVKIAKV

SEQ ID NO: 4311 - protein, 17 aa, Artificial Sequence
  GFR-binding peptide
  MOD_RES (3)..(4): Xaa is C or S
KPXXAPTKLRSVKVAKV

SEQ ID NO: 4312 - protein, 19 aa, Artificial Sequence
  GFR-binding peptide
  MOD_RES (5)..(6): Xaa is C or S
SASPXXVSQDLRPVQIRKI

SEQ ID NO: 4313 - protein, 9 aa, Artificial Sequence
  GFR-binding peptide
LSNITMQIM

SEQ ID NO: 4314 - protein, 15 aa, Artificial Sequence
  GFR-binding peptide
  MOD_RES (2)..(2): Xaa is C or S
TXAPTKLSNITVQIM

SEQ ID NO: 4315 - protein, 20 aa, Artificial Sequence
  GFR-binding peptide
  MOD_RES (6)..(7): Xaa is C or S
ASAAPXXVPQALRSVKIAKV

SEQ ID NO: 4316 - protein, 18 aa, Artificial Sequence
  GFR-binding peptide
  MOD_RES (4)..(5): Xaa is C or S
PKPXXAPTKLEPLTVLYY

SEQ ID NO: 4317 - protein, 13 aa, Artificial Sequence
  GFR-binding peptide
APTQLRPVQVRKI

SEQ ID NO: 4318 - protein, 13 aa, Artificial Sequence
  GFR-binding peptide
APTKLSNITVQIM

SEQ ID NO: 4319 - protein, 15 aa, Artificial Sequence
  GFR-binding peptide
  MOD_RES (1)..(2): Xaa is C or S
XXVPQALRPVQIRKI

SEQ ID NO: 4320 - protein, 14 aa, Artificial Sequence
  GFR-binding peptide
  MOD_RES (1)..(1): Xaa is C or S
XVPTELRSVKMAKV

SEQ ID NO: 4321 - protein, 18 aa, Artificial Sequence
  GFR-binding peptide
  MOD_RES (4)..(5): Xaa is C or S
PKAXXVPTELEPLPMVYY

SEQ ID NO: 4322 - protein, 11 aa, Artificial Sequence
  GFR-binding peptide
QDLRSVKIAKV

SEQ ID NO: 4323 - protein, 14 aa, Artificial Sequence
  GFR-binding peptide
  MOD_RES (1)..(1): Xaa is C or S
XVPQALSNITIQIM

SEQ ID NO: 4324 - protein, 18 aa, Artificial Sequence
  GFR-binding peptide
  MOD_RES (4)..(5): Xaa is C or S
ASPXXVSQDLEPLPIVYY

SEQ ID NO: 4325 - protein, 20 aa, Artificial Sequence
  GFR-binding peptide
  MOD_RES (6)..(7): Xaa is C or S
YVPKPXXAPTKLSNITVQIM

SEQ ID NO: 4326 - protein, 18 aa, Artificial Sequence
  GFR-binding peptide
  MOD_RES (4)..(5): Xaa is C or S
ASPXXVPQDLRPVQIRKI

SEQ ID NO: 4327 - protein, 17 aa, Artificial Sequence
  GFR-binding peptide
  MOD_RES (2)..(2): Xaa is C or S
QXRPTQVQLEPLTVLYY

SEQ ID NO: 4328 - protein, 18 aa, Artificial Sequence
  GFR-binding peptide
  MOD_RES (3)..(3): Xaa is C or S
VQXRPTQVQLEPLTVLYY

SEQ ID NO: 4329 - protein, 16 aa, Artificial Sequence
  GFR-binding peptide
  MOD_RES (1)..(1): Xaa is C or S
XRPTQVQLSNITVQIM

SEQ ID NO: 4330 - protein, 16 aa, Artificial Sequence
  GFR-binding peptide
  MOD_RES (2)..(3): Xaa is C or S
PXXVSQDLSNITIQIM

SEQ ID NO: 4331 - protein, 11 aa, Artificial Sequence
  GFR-binding peptide
TELRSVKMAKV

SEQ ID NO: 4332 - protein, 20 aa, Artificial Sequence
  GFR-binding peptide
  MOD_RES (5)..(5): Xaa is C or S
RNVQXRPTQVQLEPLTVLYY

SEQ ID NO: 4333 - protein, 18 aa, Artificial Sequence
  GFR-binding peptide
  MOD_RES (4)..(5): Xaa is C or S
AAPXXVPQALRPVQIRKI

SEQ ID NO: 4334 - protein, 13 aa, Artificial Sequence
  GFR-binding peptide
VPQALEPLTILYY

SEQ ID NO: 4335 - protein, 10 aa, Artificial Sequence
  GFR-binding peptide
HHRPVQVRKI

SEQ ID NO: 4336 - protein, 14 aa, Artificial Sequence
  GFR-binding peptide
  MOD_RES (1)..(1): Xaa is C or S
XAPTQLSNITVQIM

SEQ ID NO: 4337 - protein, 19 aa, Artificial Sequence
  GFR-binding peptide
  MOD_RES (5)..(6): Xaa is C or S
SASPXXVPQDLSNITIQIM

SEQ ID NO: 4338 - protein, 13 aa, Artificial Sequence
  GFR-binding peptide
APTQLEPLTVLYY

SEQ ID NO: 4339 - protein, 17 aa, Artificial Sequence
  GFR-binding peptide
  MOD_RES (3)..(4): Xaa is C or S
APXXVPQALRSVKIAKV

SEQ ID NO: 4340 - protein, 13 aa, Artificial Sequence
  GFR-binding peptide
SRVHHEPLTVLYY

SEQ ID NO: 4341 - protein, 12 aa, Artificial Sequence
  GFR-binding peptide
PTEERPVQMRKI

SEQ ID NO: 4342 - protein, 16 aa, Artificial Sequence
  GFR-binding peptide
  MOD_RES (2)..(3): Xaa is C or S
AXXVPTELSNITMQIM

SEQ ID NO: 4343 - protein, 19 aa, Artificial Sequence
  GFR-binding peptide
  MOD_RES (5)..(6): Xaa is C or S
VPKPXXAPTQLSNITVQIM

SEQ ID NO: 4344 - protein, 10 aa, Artificial Sequence
  GFR-binding peptide
EERSVKMAKV

SEQ ID NO: 4345 - protein, 12 aa, Artificial Sequence
  GFR-binding peptide
PTQLEPLTVLYY

SEQ ID NO: 4346 - protein, 18 aa, Artificial Sequence
  GFR-binding peptide
  MOD_RES (4)..(5): Xaa is C or S
PKPXXAPTKLEPLPVVYY

SEQ ID NO: 4347 - protein, 17 aa, Artificial Sequence
  GFR-binding peptide
  MOD_RES (3)..(4): Xaa is C or S
SPXXVPQDLRSVKIAKV

SEQ ID NO: 4348 - protein, 11 aa, Artificial Sequence
  GFR-binding peptide
TKLRSVKVAKV

SEQ ID NO: 4349 - protein, 17 aa, Artificial Sequence
  GFR-binding peptide
  MOD_RES (3)..(4): Xaa is C or S
KAXXVPTELRSVKMAKV

SEQ ID NO: 4350 - protein, 12 aa, Artificial Sequence
  GFR-binding peptide
PTEEEPLTMLYY

SEQ ID NO: 4351 - protein, 12 aa, Artificial Sequence
  GFR-binding peptide
PQDLSNITIQIM

SEQ ID NO: 4352 - protein, 11 aa, Artificial Sequence
  GFR-binding peptide
TELEPLPMVYY

SEQ ID NO: 4353 - protein, 16 aa, Artificial Sequence
  GFR-binding peptide
  MOD_RES (2)..(3): Xaa is C or S
PXXAPTKLSNITVQIM

SEQ ID NO: 4354 - protein, 19 aa, Artificial Sequence
  GFR-binding peptide
  MOD_RES (5)..(6): Xaa is C or S
VPKPXXAPTQLRPVQVRKI

SEQ ID NO: 4355 - protein, 20 aa, Artificial Sequence
  GFR-binding peptide
  MOD_RES (5)..(5): Xaa is C or S
SSVKXQPSRVHHEPLTVLYY

SEQ ID NO: 4356 - protein, 19 aa, Artificial Sequence
  GFR-binding peptide
  MOD_RES (4)..(4): Xaa is C or S
NVQXRPTQVQLRSVKVAKV

SEQ ID NO: 4357 - protein, 11 aa, Artificial Sequence
  GFR-binding peptide
QALSNITIQIM

SEQ ID NO: 4358 - protein, 16 aa, Artificial Sequence
  GFR-binding peptide
  MOD_RES (2)..(3): Xaa is C or S
PXXVPQALEPLTILYY

SEQ ID NO: 4359 - protein, 15 aa, Artificial Sequence
  GFR-binding peptide
  MOD_RES (1)..(2): Xaa is C or S
XXAPTQLSNITVQIM

SEQ ID NO: 4360 - protein, 16 aa, Artificial Sequence
  GFR-binding peptide
  MOD_RES (2)..(3): Xaa is C or S
PXXVSQDLRPVQIRKI

SEQ ID NO: 4361 - protein, 19 aa, Artificial Sequence
  GFR-binding peptide
  MOD_RES (6)..(6): Xaa is C or S
VTKPTXAPTKLRSVKVAKV

SEQ ID NO: 4362 - protein, 18 aa, Artificial Sequence
  GFR-binding peptide
  MOD_RES (4)..(5): Xaa is C or S
AAPXXVPQALSNITIQIM

SEQ ID NO: 4363 - protein, 12 aa, Artificial Sequence
  GFR-binding peptide
PQALRSVKIAKV

SEQ ID NO: 4364 - protein, 11 aa, Artificial Sequence
  GFR-binding peptide
VHHSNITVQIM

SEQ ID NO: 4365 - protein, 13 aa, Artificial Sequence
  GFR-binding peptide
VSQDLSNITIQIM

SEQ ID NO: 4366 - protein, 10 aa, Artificial Sequence
  GFR-binding peptide
HHSNITVQIM

SEQ ID NO: 4367 - protein, 18 aa, Artificial Sequence
  GFR-binding peptide
  MOD_RES (3)..(3): Xaa is C or S
VQXRPTQVQLEPLPVVYY

SEQ ID NO: 4368 - protein, 18 aa, Artificial Sequence
  GFR-binding peptide
  MOD_RES (4)..(5): Xaa is C or S
ASPXXVSQDLRSVKIAKV

SEQ ID NO: 4369 - protein, 12 aa, Artificial Sequence
  GFR-binding peptide
SQDLRPVQIRKI

SEQ ID NO: 4370 - protein, 19 aa, Artificial Sequence
  GFR-binding peptide
  MOD_RES (4)..(4): Xaa is C or S
SVKXQPSRVHHEPLPVVYY

SEQ ID NO: 4371 - protein, 11 aa, Artificial Sequence
  GFR-binding peptide
QDLEPLPIVYY

SEQ ID NO: 4372 - protein, 9 aa, Artificial Sequence
  GFR-binding peptide
LRSVKIAKV

SEQ ID NO: 4373 - protein, 18 aa, Artificial Sequence
  GFR-binding peptide
  MOD_RES (4)..(5): Xaa is C or S
PKAXXVPTELEPLTMLYY

SEQ ID NO: 4374 - protein, 12 aa, Artificial Sequence
  GFR-binding peptide
PTKLRPVQVRKI

SEQ ID NO: 4375 - protein, 10 aa, Artificial Sequence
  GFR-binding peptide
ELEPLTMLYY

SEQ ID NO: 4376 - protein, 14 aa, Artificial Sequence
  GFR-binding peptide
  MOD_RES (1)..(1): Xaa is C or S
XAPTKLRSVKVAKV

SEQ ID NO: 4377 - protein, 18 aa, Artificial Sequence
  GFR-binding peptide
  MOD_RES (4)..(5): Xaa is C or S
ASPXXVPQDLSNITIQIM

SEQ ID NO: 4378 - protein, 18 aa, Artificial Sequence
  GFR-binding peptide
  MOD_RES (4)..(5): Xaa is C or S
PKPXXAPTKLRPVQVRKI

SEQ ID NO: 4379 - protein, 16 aa, Artificial Sequence
  GFR-binding peptide
  MOD_RES (3)..(3): Xaa is C or S
PTXAPTKLSNITVQIM

SEQ ID NO: 4380 - protein, 9 aa, Artificial Sequence
  GFR-binding peptide
LRPVQMRKI

SEQ ID NO: 4381 - protein, 12 aa, Artificial Sequence
  GFR-binding peptide
PTEEEPLPMVYY

SEQ ID NO: 4382 - protein, 11 aa, Artificial Sequence
  GFR-binding peptide
TEERSVKMAKV

SEQ ID NO: 4383 - protein, 10 aa, Artificial Sequence
  GFR-binding peptide
ELRSVKMAKV

SEQ ID NO: 4384 - protein, 9 aa, Artificial Sequence
  GFR-binding peptide
EEPLTMLYY

SEQ ID NO: 4385 - protein, 12 aa, Artificial Sequence
  GFR-binding peptide
PTQLRSVKVAKV

SEQ ID NO: 4386 - protein, 19 aa, Artificial Sequence
  GFR-binding peptide
  MOD_RES (5)..(6): Xaa is C or S
IPKAXXVPTELSNITMQIM

SEQ ID NO: 4387 - protein, 17 aa, Artificial Sequence
  GFR-binding peptide
  MOD_RES (3)..(4): Xaa is C or S
KPXXAPTKLEPLPVVYY

SEQ ID NO: 4388 - protein, 13 aa, Artificial Sequence
  GFR-binding peptide
VPQALRPVQIRKI

SEQ ID NO: 4389 - protein, 12 aa, Artificial Sequence
  GFR-binding peptide
SQDLEPLPIVYY

SEQ ID NO: 4390 - protein, 11 aa, Artificial Sequence
  GFR-binding peptide
VHHEPLTVLYY

SEQ ID NO: 4391 - protein, 10 aa, Artificial Sequence
  GFR-binding peptide
KLRSVKVAKV

SEQ ID NO: 4392 - protein, 19 aa, Artificial Sequence
  GFR-binding peptide
  MOD_RES (5)..(6): Xaa is C or S
VPKPXXAPTKLSNITVQIM

SEQ ID NO: 4393 - protein, 11 aa, Artificial Sequence
  GFR-binding peptide
VQLRSVKVAKV

SEQ ID NO: 4394 - protein, 16 aa, Artificial Sequence
  GFR-binding peptide
  MOD_RES (2)..(3): Xaa is C or S
PXXVPQALSNITIQIM

SEQ ID NO: 4395 - protein, 18 aa, Artificial Sequence
  GFR-binding peptide
  MOD_RES (4)..(5): Xaa is C or S
PKPXXAPTQLRSVKVAKV

SEQ ID NO: 4396 - protein, 11 aa, Artificial Sequence
  GFR-binding peptide
TELEPLTMLYY

SEQ ID NO: 4397 - protein, 16 aa, Artificial Sequence
  GFR-binding peptide
  MOD_RES (2)..(3): Xaa is C or S
PXXVPQDLSNITIQIM

SEQ ID NO: 4398 - protein, 14 aa, Artificial Sequence
  GFR-binding peptide
PSRVHHEPLPVVYY

SEQ ID NO: 4399 - protein, 17 aa, Artificial Sequence
  GFR-binding peptide
  MOD_RES (4)..(4): Xaa is C or S
KPTXAPTKLSNITVQIM

SEQ ID NO: 4400 - protein, 20 aa, Artificial Sequence
  GFR-binding peptide
  MOD_RES (6)..(7): Xaa is C or S
ASASPXXVSQDLSNITIQIM

SEQ ID NO: 4401 - protein, 9 aa, Artificial Sequence
  GFR-binding peptide
LSNITVQIM

SEQ ID NO: 4402 - protein, 18 aa, Artificial Sequence
  GFR-binding peptide
  MOD_RES (5)..(5): Xaa is C or S
EGLEXVPTEERSVKMAKV

SEQ ID NO: 4403 - protein, 16 aa, Artificial Sequence
  GFR-binding peptide
  MOD_RES (2)..(3): Xaa is C or S
PXXAPTQLRPVQVRKI

SEQ ID NO: 4404 - protein, 15 aa, Artificial Sequence
  GFR-binding peptide
  MOD_RES (1)..(2): Xaa is C or S
XXVSQDLSNITIQIM

SEQ ID NO: 4405 - protein, 9 aa, Artificial Sequence
  GFR-binding peptide
HRPVQVRKI

SEQ ID NO: 4406 - protein, 16 aa, Artificial Sequence
  GFR-binding peptide
  MOD_RES (3)..(3): Xaa is C or S
LEXVPTEEEPLPMVYY

SEQ ID NO: 4407 - protein, 17 aa, Artificial Sequence
  GFR-binding peptide
  MOD_RES (2)..(2): Xaa is C or S
QXRPTQVQLEPLPVVYY

SEQ ID NO: 4408 - protein, 15 aa, Artificial Sequence
  GFR-binding peptide
  MOD_RES (2)..(2): Xaa is C or S
TXAPTKLRPVQVRKI

SEQ ID NO: 4409 - protein, 14 aa, Artificial Sequence
  GFR-binding peptide
  MOD_RES (1)..(1): Xaa is C or S
XVPQDLRSVKIAKV

SEQ ID NO: 4410 - protein, 13 aa, Artificial Sequence
  GFR-binding peptide
VPQALSNITIQIM

SEQ ID NO: 4411 - protein, 17 aa, Artificial Sequence
  GFR-binding peptide
  MOD_RES (3)..(4): Xaa is C or S
KAXXVPTELEPLPMVYY

SEQ ID NO: 4412 - protein, 10 aa, Artificial Sequence
  GFR-binding peptide
EEEPLPMVYY

SEQ ID NO: 4413 - protein, 18 aa, Artificial Sequence
  GFR-binding peptide
  MOD_RES (3)..(3): Xaa is C or S
VQXRPTQVQLSNITVQIM

SEQ ID NO: 4414 - protein, 11 aa, Artificial Sequence
  GFR-binding peptide
TKLEPLTVLYY

SEQ ID NO: 4415 - protein, 10 aa, Artificial Sequence
  GFR-binding peptide
HHEPLPVVYY

SEQ ID NO: 4416 - protein, 14 aa, Artificial Sequence
  GFR-binding peptide
PSRVHHRPVQVRKI

SEQ ID NO: 4417 - protein, 14 aa, Artificial Sequence
  GFR-binding peptide
  MOD_RES (1)..(1): Xaa is C or S
XAPTQLRPVQVRKI

SEQ ID NO: 4418 - protein, 15 aa, Artificial Sequence
  GFR-binding peptide
  MOD_RES (1)..(2): Xaa is C or S
XXAPTQLEPLPVVYY

SEQ ID NO: 4419 - protein, 19 aa, Artificial Sequence
  GFR-binding peptide
  MOD_RES (5)..(6): Xaa is C or S
SAAPXXVPQALRPVQIRKI

SEQ ID NO: 4420 - protein, 17 aa, Artificial Sequence
  GFR-binding peptide
  MOD_RES (3)..(4): Xaa is C or S
KPXXAPTKLEPLTVLYY

SEQ ID NO: 4421 - protein, 10 aa, Artificial Sequence
  GFR-binding peptide
QLSNITVQIM

SEQ ID NO: 4422 - protein, 20 aa, Artificial Sequence
  GFR-binding peptide
  MOD_RES (6)..(7): Xaa is C or S
ASAAPXXVPQALEPLTILYY

SEQ ID NO: 4423 - protein, 18 aa, Artificial Sequence
  GFR-binding peptide
  MOD_RES (5)..(5): Xaa is C or S
TKPTXAPTKLSNITVQIM

SEQ ID NO: 4424 - protein, 15 aa, Artificial Sequence
  GFR-binding peptide
RPTQVQLSNITVQIM

SEQ ID NO: 4425 - protein, 14 aa, Artificial Sequence
  GFR-binding peptide
  MOD_RES (1)..(1): Xaa is C or S
XVPQDLEPLPIVYY

SEQ ID NO: 4426 - protein, 20 aa, Artificial Sequence
  GFR-binding peptide
  MOD_RES (5)..(5): Xaa is C or S
RNVQXRPTQVQLSNITVQIM

SEQ ID NO: 4427 - protein, 11 aa, Artificial Sequence
  GFR-binding peptide
TQLRSVKVAKV

SEQ ID NO: 4428 - protein, 15 aa, Artificial Sequence
  GFR-binding peptide
  MOD_RES (1)..(2): Xaa is C or S
XXVPQDLSNITIQIM

SEQ ID NO: 4429 - protein, 13 aa, Artificial Sequence
  GFR-binding peptide
APTKLRPVQVRKI

SEQ ID NO: 4430 - protein, 18 aa, Artificial Sequence
  GFR-binding peptide
  MOD_RES (4)..(5): Xaa is C or S
PKPXXAPTQLEPLTVLYY

SEQ ID NO: 4431 - protein, 11 aa, Artificial Sequence
  GFR-binding peptide
TELRPVQMRKI

SEQ ID NO: 4432 - protein, 20 aa, Artificial Sequence
  GFR-binding peptide
  MOD_RES (6)..(7): Xaa is C or S
TVPKPXXAPTQLEPLPVVYY

SEQ ID NO: 4433 - protein, 19 aa, Artificial Sequence
  GFR-binding peptide
  MOD_RES (4)..(4): Xaa is C or S
SVKXQPSRVHHRPVQVRKI

SEQ ID NO: 4434 - protein, 13 aa, Artificial Sequence
  GFR-binding peptide
APTQLSNITVQIM

SEQ ID NO: 4435 - protein, 16 aa, Artificial Sequence
  GFR-binding peptide
  MOD_RES (2)..(3): Xaa is C or S
PXXAPTQLEPLPVVYY

SEQ ID NO: 4436 - protein, 13 aa, Artificial Sequence
  GFR-binding peptide
TQVQLEPLTVLYY

SEQ ID NO: 4437 - protein, 15 aa, Artificial Sequence
  GFR-binding peptide
  MOD_RES (1)..(2): Xaa is C or S
XXVPTELRSVKMAKV

SEQ ID NO: 4438 - protein, 11 aa, Artificial Sequence
  GFR-binding peptide
VQLSNITVQIM

SEQ ID NO: 4439 - protein, 9 aa, Artificial Sequence
  GFR-binding peptide
HEPLPVVYY

SEQ ID NO: 4440 - protein, 20 aa, Artificial Sequence
  GFR-binding peptide
  MOD_RES (6)..(7): Xaa is C or S
SIPKAXXVPTELRPVQMRKI

SEQ ID NO: 4441 - protein, 17 aa, Artificial Sequence
  GFR-binding peptide
  MOD_RES (4)..(4): Xaa is C or S
KPTXAPTKLRPVQVRKI

SEQ ID NO: 4442 - protein, 12 aa, Artificial Sequence
  GFR-binding peptide
SQDLSNITIQIM

SEQ ID NO: 4443 - protein, 16 aa, Artificial Sequence
  GFR-binding peptide
  MOD_RES (2)..(3): Xaa is C or S
AXXVPTELRPVQMRKI

SEQ ID NO: 4444 - protein, 17 aa, Artificial Sequence
  GFR-binding peptide
  MOD_RES (2)..(2): Xaa is C or S
KXQPSRVHHSNITVQIM

SEQ ID NO: 4445 - protein, 18 aa, Artificial Sequence
  GFR-binding peptide
  MOD_RES (4)..(5): Xaa is C or S
AAPXXVPQALEPLTILYY

SEQ ID NO: 4446 - protein, 11 aa, Artificial Sequence
  GFR-binding peptide
TKLEPLPVVYY

SEQ ID NO: 4447 - protein, 14 aa, Artificial Sequence
  GFR-binding peptide
PTQVQLEPLTVLYY

SEQ ID NO: 4448 - protein, 15 aa, Artificial Sequence
  GFR-binding peptide
  MOD_RES (1)..(2): Xaa is C or S
XXAPTKLRPVQVRKI

SEQ ID NO: 4449 - protein, 10 aa, Artificial Sequence
  GFR-binding peptide
ALSNITIQIM

SEQ ID NO: 4450 - protein, 19 aa, Artificial Sequence
  GFR-binding peptide
  MOD_RES (5)..(6): Xaa is C or S
VPKPXXAPTQLEPLPVVYY

SEQ ID NO: 4451 - protein, 19 aa, Artificial Sequence
  GFR-binding peptide
  MOD_RES (4)..(4): Xaa is C or S
NVQXRPTQVQLEPLPVVYY

SEQ ID NO: 4452 - protein, 13 aa, Artificial Sequence
  GFR-binding peptide
TQVQLEPLPVVYY

SEQ ID NO: 4453 - protein, 15 aa, Artificial Sequence
  GFR-binding peptide
  MOD_RES (1)..(2): Xaa is C or S
XXAPTQLEPLTVLYY

SEQ ID NO: 4454 - protein, 17 aa, Artificial Sequence
  GFR-binding peptide
  MOD_RES (3)..(4): Xaa is C or S
KPXXAPTQLSNITVQIM

SEQ ID NO: 4455 - protein, 19 aa, Artificial Sequence
  GFR-binding peptide
  MOD_RES (6)..(6): Xaa is C or S
VTKPTXAPTKLSNITVQIM

SEQ ID NO: 4456 - protein, 19 aa, Artificial Sequence
  GFR-binding peptide
  MOD_RES (5)..(6): Xaa is C or S
VPKPXXAPTKLRSVKVAKV

SEQ ID NO: 4457 - protein, 20 aa, Artificial Sequence
  GFR-binding peptide
  MOD_RES (6)..(7): Xaa is C or S
ASASPXXVSQDLRSVKIAKV

SEQ ID NO: 4458 - protein, 12 aa, Artificial Sequence
  GFR-binding peptide
PQALRPVQIRKI

SEQ ID NO: 4459 - protein, 14 aa, Artificial Sequence
  GFR-binding peptide
  MOD_RES (1)..(1): Xaa is C or S
XVPQALRPVQIRKI

SEQ ID NO: 4460 - protein, 18 aa, Artificial Sequence
  GFR-binding peptide
  MOD_RES (4)..(5): Xaa is C or S
PKAXXVPTELRPVQMRKI

SEQ ID NO: 4461 - protein, 9 aa, Artificial Sequence
  GFR-binding peptide
LRSVKVAKV

SEQ ID NO: 4462 - protein, 20 aa, Artificial Sequence
  GFR-binding peptide
  MOD_RES (6)..(7): Xaa is C or S
KIPKAXXVPTELSNITMQIM

SEQ ID NO: 4463 - protein, 18 aa, Artificial Sequence
  GFR-binding peptide
  MOD_RES (4)..(5): Xaa is C or S
ASPXXVPQDLEPLPIVYY

SEQ ID NO: 4464 - protein, 18 aa, Artificial Sequence
  GFR-binding peptide
  MOD_RES (4)..(5): Xaa is C or S
ASPXXVSQDLRPVQIRKI

SEQ ID NO: 4465 - protein, 15 aa, Artificial Sequence
  GFR-binding peptide
  MOD_RES (1)..(2): Xaa is C or S
XXAPTKLSNITVQIM

SEQ ID NO: 4466 - protein, 20 aa, Artificial Sequence
  GFR-binding peptide
  MOD_RES (6)..(7): Xaa is C or S
ASASPXXVSQDLRPVQIRKI

SEQ ID NO: 4467 - protein, 13 aa, Artificial Sequence
  GFR-binding peptide
VPQDLSNITIQIM

SEQ ID NO: 4468 - protein, 11 aa, Artificial Sequence
  GFR-binding peptide
VQLEPLPVVYY

SEQ ID NO: 4469 - protein, 20 aa, Artificial Sequence
  GFR-binding peptide
  MOD_RES (5)..(5): Xaa is C or S
RNVQXRPTQVQLEPLPVVYY

SEQ ID NO: 4470 - protein, 19 aa, Artificial Sequence
  GFR-binding peptide
  MOD_RES (5)..(6): Xaa is C or S
VPKPXXAPTKLRPVQVRKI

SEQ ID NO: 4471 - protein, 17 aa, Artificial Sequence
  GFR-binding peptide
  MOD_RES (4)..(4): Xaa is C or S
KPTXAPTKLRSVKVAKV

SEQ ID NO: 4472 - protein, 12 aa, Artificial Sequence
  GFR-binding peptide
PQALEPLTILYY

SEQ ID NO: 4473 - protein, 20 aa, Artificial Sequence
  GFR-binding peptide
  MOD_RES (6)..(7): Xaa is C or S
TVPKPXXAPTQLRSVKVAKV

SEQ ID NO: 4474 - protein, 9 aa, Artificial Sequence
  GFR-binding peptide
LSNITIQIM

SEQ ID NO: 4475 - protein, 18 aa, Artificial Sequence
  GFR-binding peptide
  MOD_RES (4)..(5): Xaa is C or S
ASPXXVPQDLRSVKIAKV

SEQ ID NO: 4476 - protein, 12 aa, Artificial Sequence
  GFR-binding peptide
PQDLRPVQIRKI

SEQ ID NO: 4477 - protein, 11 aa, Artificial Sequence
  GFR-binding peptide
TKLRPVQVRKI

SEQ ID NO: 4478 - protein, 20 aa, Artificial Sequence
  GFR-binding peptide
  MOD_RES (6)..(7): Xaa is C or S
KIPKAXXVPTELRPVQMRKI

SEQ ID NO: 4479 - protein, 16 aa, Artificial Sequence
  GFR-binding peptide
  MOD_RES (3)..(3): Xaa is C or S
LEXVPTEEEPLTMLYY

SEQ ID NO: 4480 - protein, 18 aa, Artificial Sequence
  GFR-binding peptide
  MOD_RES (4)..(5): Xaa is C or S
ASPXXVSQDLSNITIQIM

SEQ ID NO: 4481 - protein, 18 aa, Artificial Sequence
  GFR-binding peptide
  MOD_RES (5)..(5): Xaa is C or S
TKPTXAPTKLEPLPVVYY

SEQ ID NO: 4482 - protein, 14 aa, Artificial Sequence
  GFR-binding peptide
  MOD_RES (1)..(1): Xaa is C or S
XAPTQLRSVKVAKV

SEQ ID NO: 4483 - protein, 15 aa, Artificial Sequence
  GFR-binding peptide
  MOD_RES (1)..(2): Xaa is C or S
XXVPQALSNITIQIM

SEQ ID NO: 4484 - protein, 14 aa, Artificial Sequence
  GFR-binding peptide
  MOD_RES (1)..(1): Xaa is C or S
XVPQDLRPVQIRKI

SEQ ID NO: 4485 - protein, 15 aa, Artificial Sequence
  GFR-binding peptide
  MOD_RES (1)..(2): Xaa is C or S
XXVPQALEPLTILYY

SEQ ID NO: 4486 - protein, 18 aa, Artificial Sequence
  GFR-binding peptide
  MOD_RES (4)..(5): Xaa is C or S
PKPXXAPTKLSNITVQIM

SEQ ID NO: 4487 - protein, 15 aa, Artificial Sequence
  GFR-binding peptide
RPTQVQLEPLPVVYY

SEQ ID NO: 4488 - protein, 13 aa, Artificial Sequence
  GFR-binding peptide
APTKLEPLTVLYY

SEQ ID NO: 4489 - protein, 18 aa, Artificial Sequence
  GFR-binding peptide
  MOD_RES (4)..(5): Xaa is C or S
PKAXXVPTELRSVKMAKV

SEQ ID NO: 4490 - protein, 12 aa, Artificial Sequence
  GFR-binding peptide
PQALSNITIQIM

SEQ ID NO: 4491 - protein, 20 aa, Artificial Sequence
  GFR-binding peptide
  MOD_RES (6)..(7): Xaa is C or S
KIPKAXXVPTELEPLPMVYY

SEQ ID NO: 4492 - protein, 10 aa, Artificial Sequence
  GFR-binding peptide
ALEPLTILYY

SEQ ID NO: 4493 - protein, 14 aa, Artificial Sequence
  GFR-binding peptide
  MOD_RES (1)..(1): Xaa is C or S
XVPQALEPLTILYY

SEQ ID NO: 4494 - protein, 19 aa, Artificial Sequence
  GFR-binding peptide
  MOD_RES (5)..(6): Xaa is C or S
SAAPXXVPQALRSVKIAKV

SEQ ID NO: 4495 - protein, 16 aa, Artificial Sequence
  GFR-binding peptide
  MOD_RES (1)..(1): Xaa is C or S
XRPTQVQLEPLTVLYY

SEQ ID NO: 4496 - protein, 14 aa, Artificial Sequence
  GFR-binding peptide
  MOD_RES (1)..(1): Xaa is C or S
XVSQDLSNITIQIM

SEQ ID NO: 4497 - protein, 17 aa, Artificial Sequence
  GFR-binding peptide
  MOD_RES (3)..(4): Xaa is C or S
KAXXVPTELRPVQMRKI

SEQ ID NO: 4498 - protein, 15 aa, Artificial Sequence
  GFR-binding peptide
  MOD_RES (2)..(2): Xaa is C or S
EXVPTEEEPLPMVYY

SEQ ID NO: 4499 - protein, 18 aa, Artificial Sequence
  GFR-binding peptide
  MOD_RES (4)..(5): Xaa is C or S
PKPXXAPTQLRPVQVRKI

SEQ ID NO: 4500 - protein, 17 aa, Artificial Sequence
  GFR-binding peptide
  MOD_RES (2)..(2): Xaa is C or S
KXQPSRVHHEPLTVLYY

SEQ ID NO: 4501 - protein, 15 aa, Artificial Sequence
  GFR-binding peptide
  MOD_RES (1)..(2): Xaa is C or S
XXAPTQLRPVQVRKI

SEQ ID NO: 4502 - protein, 10 aa, Artificial Sequence
  GFR-binding peptide
EEEPLTMLYY

SEQ ID NO: 4503 - protein, 9 aa, Artificial Sequence
  GFR-binding peptide
HEPLTVLYY

SEQ ID NO: 4504 - protein, 17 aa, Artificial Sequence
  GFR-binding peptide
  MOD_RES (2)..(2): Xaa is C or S
QXRPTQVQLRSVKVAKV

SEQ ID NO: 4505 - protein, 13 aa, Artificial Sequence
  GFR-binding peptide
VPTELRSVKMAKV

SEQ ID NO: 4506 - protein, 17 aa, Artificial Sequence
  GFR-binding peptide
  MOD_RES (3)..(4): Xaa is C or S
KPXXAPTKLSNITVQIM

SEQ ID NO: 4507 - protein, 15 aa, Artificial Sequence
  GFR-binding peptide
  MOD_RES (1)..(2): Xaa is C or S
XXAPTKLEPLTVLYY

SEQ ID NO: 4508 - protein, 20 aa, Artificial Sequence
  GFR-binding peptide
  MOD_RES (7)..(7): Xaa is C or S
HVTKPTXAPTKLEPLTVLYY

SEQ ID NO: 4509 - protein, 10 aa, Artificial Sequence
  GFR-binding peptide
DLSNITIQIM

SEQ ID NO: 4510 - protein, 12 aa, Artificial Sequence
  GFR-binding peptide
PQDLEPLPIVYY

SEQ ID NO: 4511 - protein, 14 aa, Artificial Sequence
  GFR-binding peptide
  MOD_RES (1)..(1): Xaa is C or S
XAPTKLEPLPVVYY

SEQ ID NO: 4512 - protein, 19 aa, Artificial Sequence
  GFR-binding peptide
  MOD_RES (4)..(4): Xaa is C or S
SVKXQPSRVHHEPLTVLYY

SEQ ID NO: 4513 - protein, 20 aa, Artificial Sequence
  GFR-binding peptide
  MOD_RES (6)..(7): Xaa is C or S
SIPKAXXVPTELRSVKMAKV

SEQ ID NO: 4514 - protein, 19 aa, Artificial Sequence
  GFR-binding peptide
  MOD_RES (4)..(4): Xaa is C or S
SVKXQPSRVHHSNITVQIM

SEQ ID NO: 4515 - protein, 18 aa, Artificial Sequence
  GFR-binding peptide
  MOD_RES (4)..(5): Xaa is C or S
PKPXXAPTQLEPLPVVYY

SEQ ID NO: 4516 - protein, 16 aa, Artificial Sequence
  GFR-binding peptide
  MOD_RES (2)..(3): Xaa is C or S
PXXAPTQLEPLTVLYY

SEQ ID NO: 4517 - protein, 19 aa, Artificial Sequence
  GFR-binding peptide
  MOD_RES (6)..(6): Xaa is C or S
VTKPTXAPTKLEPLPVVYY

SEQ ID NO: 4518 - protein, 13 aa, Artificial Sequence
  GFR-binding peptide
APTQLEPLPVVYY

SEQ ID NO: 4519 - protein, 19 aa, Artificial Sequence
  GFR-binding peptide
  MOD_RES (4)..(4): Xaa is C or S
NVQXRPTQVQLSNITVQIM

SEQ ID NO: 4520 - protein, 16 aa, Artificial Sequence
  GFR-binding peptide
  MOD_RES (2)..(3): Xaa is C or S
PXXAPTQLSNITVQIM

SEQ ID NO: 4521 - protein, 20 aa, Artificial Sequence
  GFR-binding peptide
  MOD_RES (7)..(7): Xaa is C or S
HVTKPTXAPTKLSNITVQIM

SEQ ID NO: 4522 - protein, 9 aa, Artificial Sequence
  GFR-binding peptide
HSNITVQIM

SEQ ID NO: 4523 - protein, 16 aa, Artificial Sequence
  GFR-binding peptide
  MOD_RES (2)..(3): Xaa is C or S
AXXVPTELEPLPMVYY

SEQ ID NO: 4524 - protein, 19 aa, Artificial Sequence
  GFR-binding peptide
  MOD_RES (4)..(4): Xaa is C or S
NVQXRPTQVQLEPLTVLYY

SEQ ID NO: 4525 - protein, 15 aa, Artificial Sequence
  GFR-binding peptide
  MOD_RES (2)..(2): Xaa is C or S
EXVPTEERPVQMRKI

SEQ ID NO: 4526 - protein, 14 aa, Artificial Sequence
  GFR-binding peptide
  MOD_RES (1)..(1): Xaa is C or S
XAPTKLRPVQVRKI

SEQ ID NO: 4527 - protein, 18 aa, Artificial Sequence
  GFR-binding peptide
  MOD_RES (4)..(5): Xaa is C or S
PPTXXVPTRLNAISILYF

SEQ ID NO: 4528 - protein, 16 aa, Artificial Sequence
  GFR-binding peptide
  MOD_RES (2)..(3): Xaa is C or S
PXXTPTKMNAISMLYF

SEQ ID NO: 4529 - protein, 14 aa, Artificial Sequence
  GFR-binding peptide
  MOD_RES (1)..(1): Xaa is C or S
XVPTKLNAISILYF

SEQ ID NO: 4530 - protein, 9 aa, Artificial Sequence
  GFR-binding peptide
TNAISMLYF

SEQ ID NO: 4531 - protein, 17 aa, Artificial Sequence
  GFR-binding peptide
  MOD_RES (3)..(4): Xaa is C or S
KAXXAPTKLNAISVLYF

SEQ ID NO: 4532 - protein, 20 aa, Artificial Sequence
  GFR-binding peptide
  MOD_RES (6)..(7): Xaa is C or S
AAPASXXVPARLNAISILYF

SEQ ID NO: 4533 - protein, 15 aa, Artificial Sequence
  GFR-binding peptide
  MOD_RES (1)..(2): Xaa is C or S
XXAPVKTNAISMLYF

SEQ ID NO: 4534 - protein, 12 aa, Artificial Sequence
  GFR-binding peptide
PTELNAISMLYF

SEQ ID NO: 4535 - protein, 12 aa, Artificial Sequence
  GFR-binding peptide
PARLNAISILYF

SEQ ID NO: 4536 - protein, 17 aa, Artificial Sequence
  GFR-binding peptide
  MOD_RES (3)..(4): Xaa is C or S
KAXXVPTKLNAISVLYF

SEQ ID NO: 4537 - protein, 9 aa, Artificial Sequence
  GFR-binding peptide
MNAISMLYF

SEQ ID NO: 4538 - protein, 19 aa, Artificial Sequence
  GFR-binding peptide
  MOD_RES (5)..(6): Xaa is C or S
TPPTXXVPTRLNAISILYF

SEQ ID NO: 4539 - protein, 15 aa, Artificial Sequence
  GFR-binding peptide
  MOD_RES (1)..(2): Xaa is C or S
XXTPTKMNAISMLYF

SEQ ID NO: 4540 - protein, 11 aa, Artificial Sequence
  GFR-binding peptide
TKMNAISMLYF

SEQ ID NO: 4541 - protein, 10 aa, Artificial Sequence
  GFR-binding peptide
ELNAISMLYF

SEQ ID NO: 4542 - protein, 10 aa, Artificial Sequence
  GFR-binding peptide
KLNAISILYF

SEQ ID NO: 4543 - protein, 17 aa, Artificial Sequence
  GFR-binding peptide
  MOD_RES (3)..(4): Xaa is C or S
GPXXTPTKMNAISMLYF

SEQ ID NO: 4544 - protein, 18 aa, Artificial Sequence
  GFR-binding peptide
  MOD_RES (4)..(5): Xaa is C or S
PKAXXAPTKLNAISVLYF

SEQ ID NO: 4545 - protein, 16 aa, Artificial Sequence
  GFR-binding peptide
  MOD_RES (2)..(3): Xaa is C or S
TXXVPTRLNAISILYF

SEQ ID NO: 4546 - protein, 20 aa, Artificial Sequence
  GFR-binding peptide
  MOD_RES (6)..(7): Xaa is C or S
STPPTXXVPTRLNAISILYF

SEQ ID NO: 4547 - protein, 13 aa, Artificial Sequence
  GFR-binding peptide
VPTKLNAISVLYF

SEQ ID NO: 4548 - protein, 20 aa, Artificial Sequence
  GFR-binding peptide
  MOD_RES (6)..(7): Xaa is C or S
KIPKAXXVPTELNAISMLYF

SEQ ID NO: 4549 - protein, 19 aa, Artificial Sequence
  GFR-binding peptide
  MOD_RES (5)..(6): Xaa is C or S
VPKAXXAPTKLNAISVLYF

SEQ ID NO: 4550 - protein, 13 aa, Artificial Sequence
  GFR-binding peptide
VPTRLNAISILYF

SEQ ID NO: 4551 - protein, 19 aa, Artificial Sequence
  GFR-binding peptide
  MOD_RES (5)..(6): Xaa is C or S
IPKAXXVPTELNAISMLYF

SEQ ID NO: 4552 - protein, 16 aa, Artificial Sequence
  GFR-binding peptide
  MOD_RES (2)..(3): Xaa is C or S
SXXVPARLNAISILYF

SEQ ID NO: 4553 - protein, 10 aa, Artificial Sequence
  GFR-binding peptide
RLNAISILYF

SEQ ID NO: 4554 - protein, 15 aa, Artificial Sequence
  GFR-binding peptide
  MOD_RES (1)..(2): Xaa is C or S
XXVPTELNAISMLYF

SEQ ID NO: 4555 - protein, 20 aa, Artificial Sequence
  GFR-binding peptide
  MOD_RES (6)..(7): Xaa is C or S
SIPKAXXVPTELNAISMLYF

SEQ ID NO: 4556 - protein, 19 aa, Artificial Sequence
  GFR-binding peptide
  MOD_RES (5)..(6): Xaa is C or S
APASXXVPARLNAISILYF

SEQ ID NO: 4557 - protein, 13 aa, Artificial Sequence
  GFR-binding peptide
VPTKLNAISILYF

SEQ ID NO: 4558 - protein, 16 aa, Artificial Sequence
  GFR-binding peptide
  MOD_RES (2)..(3): Xaa is C or S
AXXVPTELNAISMLYF

SEQ ID NO: 4559 - protein, 11 aa, Artificial Sequence
  GFR-binding peptide
ARLNAISILYF

SEQ ID NO: 4560 - protein, 18 aa, Artificial Sequence
  GFR-binding peptide
  MOD_RES (4)..(5): Xaa is C or S
AGPXXTPTKMNAISMLYF

SEQ ID NO: 4561 - protein, 15 aa, Artificial Sequence
  GFR-binding peptide
  MOD_RES (1)..(2): Xaa is C or S
XXVPTKLNAISILYF

SEQ ID NO: 4562 - protein, 20 aa, Artificial Sequence
  GFR-binding peptide
  MOD_RES (6)..(7): Xaa is C or S
KASKAXXVPTKLNAISILYF

SEQ ID NO: 4563 - protein, 9 aa, Artificial Sequence
  GFR-binding peptide
LNAISMLYF

SEQ ID NO: 4564 - protein, 13 aa, Artificial Sequence
  GFR-binding peptide
VPARLNAISILYF

SEQ ID NO: 4565 - protein, 13 aa, Artificial Sequence
  GFR-binding peptide
VPTELNAISMLYF

SEQ ID NO: 4566 - protein, 16 aa, Artificial Sequence
  GFR-binding peptide
  MOD_RES (2)..(3): Xaa is C or S
AXXAPTKLNAISVLYF

SEQ ID NO: 4567 - protein, 16 aa, Artificial Sequence
  GFR-binding peptide
  MOD_RES (2)..(3): Xaa is C or S
AXXVPTKLNAISILYF

SEQ ID NO: 4568 - protein, 19 aa, Artificial Sequence
  GFR-binding peptide
  MOD_RES (5)..(6): Xaa is C or S
SAGPXXTPTKMNAISMLYF

SEQ ID NO: 4569 - protein, 18 aa, Artificial Sequence
  GFR-binding peptide
  MOD_RES (4)..(5): Xaa is C or S
SKAXXVPTKLNAISILYF

SEQ ID NO: 4570 - protein, 20 aa, Artificial Sequence
  GFR-binding peptide
  MOD_RES (6)..(7): Xaa is C or S
GSAGPXXTPTKMNAISMLYF

SEQ ID NO: 4571 - protein, 15 aa, Artificial Sequence
  GFR-binding peptide
  MOD_RES (1)..(2): Xaa is C or S
XXVPTKLNAISVLYF

SEQ ID NO: 4572 - protein, 10 aa, Artificial Sequence
  GFR-binding peptide
KMNAISMLYF

SEQ ID NO: 4573 - protein, 15 aa, Artificial Sequence
  GFR-binding peptide
  MOD_RES (1)..(2): Xaa is C or S
XXVPTRLNAISILYF

SEQ ID NO: 4574 - protein, 10 aa, Artificial Sequence
  GFR-binding peptide
KTNAISMLYF

SEQ ID NO: 4575 - protein, 11 aa, Artificial Sequence
  GFR-binding peptide
TRLNAISILYF

SEQ ID NO: 4576 - protein, 19 aa, Artificial Sequence
  GFR-binding peptide
  MOD_RES (5)..(6): Xaa is C or S
VGKAXXVPTKLNAISVLYF

SEQ ID NO: 4577 - protein, 17 aa, Artificial Sequence
  GFR-binding peptide
  MOD_RES (3)..(4): Xaa is C or S
ASXXVPARLNAISILYF

SEQ ID NO: 4578 - protein, 14 aa, Artificial Sequence
  GFR-binding peptide
  MOD_RES (1)..(1): Xaa is C or S
XVPARLNAISILYF

SEQ ID NO: 4579 - protein, 14 aa, Artificial Sequence
  GFR-binding peptide
  MOD_RES (1)..(1): Xaa is C or S
XVPTELNAISMLYF

SEQ ID NO: 4580 - protein, 16 aa, Artificial Sequence
  GFR-binding peptide
  MOD_RES (2)..(3): Xaa is C or S
AXXVPTKLNAISVLYF

SEQ ID NO: 4581 - protein, 13 aa, Artificial Sequence
  GFR-binding peptide
TPTKMNAISMLYF

SEQ ID NO: 4582 - protein, 18 aa, Artificial Sequence
  GFR-binding peptide
  MOD_RES (4)..(5): Xaa is C or S
PSTXXAPVKTNAISMLYF

SEQ ID NO: 4583 - protein, 20 aa, Artificial Sequence
  GFR-binding peptide
  MOD_RES (6)..(7): Xaa is C or S
RVPSTXXAPVKTNAISMLYF

SEQ ID NO: 4584 - protein, 19 aa, Artificial Sequence
  GFR-binding peptide
  MOD_RES (5)..(6): Xaa is C or S
ASKAXXVPTKLNAISILYF

SEQ ID NO: 4585 - protein, 18 aa, Artificial Sequence
  GFR-binding peptide
  MOD_RES (4)..(5): Xaa is C or S
PASXXVPARLNAISILYF

SEQ ID NO: 4586 - protein, 14 aa, Artificial Sequence
  GFR-binding peptide
  MOD_RES (1)..(1): Xaa is C or S
XVPTKLNAISVLYF

SEQ ID NO: 4587 - protein, 14 aa, Artificial Sequence
  GFR-binding peptide
  MOD_RES (1)..(1): Xaa is C or S
XVPTRLNAISILYF

SEQ ID NO: 4588 - protein, 16 aa, Artificial Sequence
  GFR-binding peptide
  MOD_RES (2)..(3): Xaa is C or S
TXXAPVKTNAISMLYF

SEQ ID NO: 4589 - protein, 12 aa, Artificial Sequence
  GFR-binding peptide
PTKLNAISILYF

SEQ ID NO: 4590 - protein, 14 aa, Artificial Sequence
  GFR-binding peptide
  MOD_RES (1)..(1): Xaa is C or S
XAPVKTNAISMLYF

SEQ ID NO: 4591 - protein, 18 aa, Artificial Sequence
  GFR-binding peptide
  MOD_RES (4)..(5): Xaa is C or S
PKAXXVPTELNAISMLYF

SEQ ID NO: 4592 - protein, 12 aa, Artificial Sequence
  GFR-binding peptide
PVKTNAISMLYF

SEQ ID NO: 4593 - protein, 13 aa, Artificial Sequence
  GFR-binding peptide
APVKTNAISMLYF

SEQ ID NO: 4594 - protein, 14 aa, Artificial Sequence
  GFR-binding peptide
  MOD_RES (1)..(1): Xaa is C or S
XTPTKMNAISMLYF

SEQ ID NO: 4595 - protein, 19 aa, Artificial Sequence
  GFR-binding peptide
  MOD_RES (5)..(6): Xaa is C or S
VPSTXXAPVKTNAISMLYF

SEQ ID NO: 4596 - protein, 17 aa, Artificial Sequence
  GFR-binding peptide
  MOD_RES (3)..(4): Xaa is C or S
KAXXVPTKLNAISILYF

SEQ ID NO: 4597 - protein, 18 aa, Artificial Sequence
  GFR-binding peptide
  MOD_RES (4)..(5): Xaa is C or S
GKAXXVPTKLNAISVLYF

SEQ ID NO: 4598 - protein, 17 aa, Artificial Sequence
  GFR-binding peptide
  MOD_RES (3)..(4): Xaa is C or S
PTXXVPTRLNAISILYF

SEQ ID NO: 4599 - protein, 15 aa, Artificial Sequence
  GFR-binding peptide
  MOD_RES (1)..(2): Xaa is C or S
XXVPARLNAISILYF

SEQ ID NO: 4600 - protein, 11 aa, Artificial Sequence
  GFR-binding peptide
VKTNAISMLYF

SEQ ID NO: 4601 - protein, 17 aa, Artificial Sequence
  GFR-binding peptide
  MOD_RES (3)..(4): Xaa is C or S
KAXXVPTELNAISMLYF

SEQ ID NO: 4602 - protein, 12 aa, Artificial Sequence
  GFR-binding peptide
PTKMNAISMLYF

SEQ ID NO: 4603 - protein, 12 aa, Artificial Sequence
  GFR-binding peptide
PTRLNAISILYF

SEQ ID NO: 4604 - protein, 11 aa, Artificial Sequence
  GFR-binding peptide
TKLNAISILYF

SEQ ID NO: 4605 - protein, 11 aa, Artificial Sequence
  GFR-binding peptide
TELNAISMLYF

SEQ ID NO: 4606 - protein, 17 aa, Artificial Sequence
  GFR-binding peptide
  MOD_RES (3)..(4): Xaa is C or S
STXXAPVKTNAISMLYF

SEQ ID NO: 4607 - protein, 9 aa, Artificial Sequence
  GFR-binding peptide
LNAISILYF

SEQ ID NO: 4608 - protein, 13 aa, Artificial Sequence
  GFR-binding peptide
FYLVSIANLKTPA

SEQ ID NO: 4609 - protein, 18 aa, Artificial Sequence
  GFR-binding peptide
  MOD_RES (14)..(15): Xaa is C or S
FYLISIANLRTPVXXTPP

SEQ ID NO: 4610 - protein, 16 aa, Artificial Sequence
  GFR-binding peptide
  MOD_RES (14)..(15): Xaa is C or S
FYLMSIANMKTPTXXP

SEQ ID NO: 4611 - protein, 14 aa, Artificial Sequence
  GFR-binding peptide
  MOD_RES (14)..(14): Xaa is C or S
FYLISIANLKTPVX

SEQ ID NO: 4612 - protein, 10 aa, Artificial Sequence
  GFR-binding peptide
FYLVSIANLQ

SEQ ID NO: 4613 - protein, 9 aa, Artificial Sequence
  GFR-binding peptide
FYLMSIANT

SEQ ID NO: 4614 - protein, 17 aa, Artificial Sequence
  GFR-binding peptide
  MOD_RES (14)..(15): Xaa is C or S
FYLVSIANLKTPAXXAK

SEQ ID NO: 4615 - protein, 20 aa, Artificial Sequence
  GFR-binding peptide
  MOD_RES (14)..(15): Xaa is C or S
FYLISIANLRAPVXXSAPAA

SEQ ID NO: 4616 - protein, 14 aa, Artificial Sequence
  GFR-binding peptide
  MOD_RES (14)..(14): Xaa is C or S
FYLVSIANLQTPAX

SEQ ID NO: 4617 - protein, 15 aa, Artificial Sequence
  GFR-binding peptide
  MOD_RES (14)..(15): Xaa is C or S
FYLMSIANTKVPAXX

SEQ ID NO: 4618 - protein, 14 aa, Artificial Sequence
  GFR-binding peptide
  MOD_RES (14)..(14): Xaa is C or S
FYLVSIANLKTPAX

SEQ ID NO: 4619 - protein, 12 aa, Artificial Sequence
  GFR-binding peptide
FYLMSIANLETP

SEQ ID NO: 4620 - protein, 15 aa, Artificial Sequence
  GFR-binding peptide
  MOD_RES (14)..(14): Xaa is C or S
FYLVSIANLKTPAXT

SEQ ID NO: 4621 - protein, 12 aa, Artificial Sequence
  GFR-binding peptide
FYLISIANLRAP

SEQ ID NO: 4622 - protein, 20 aa, Artificial Sequence
  GFR-binding peptide
  MOD_RES (14)..(14): Xaa is C or S
FYLVSIANLKTPAXTPKTVH

SEQ ID NO: 4623 - protein, 17 aa, Artificial Sequence
  GFR-binding peptide
  MOD_RES (14)..(15): Xaa is C or S
FYLVSIANLKTPVXXAK

SEQ ID NO: 4624 - protein, 9 aa, Artificial Sequence
  GFR-binding peptide
FYLMSIANM

SEQ ID NO: 4625 - protein, 19 aa, Artificial Sequence
  GFR-binding peptide
  MOD_RES (14)..(15): Xaa is C or S
FYLISIANLRTPVXXTPPT

SEQ ID NO: 4626 - protein, 15 aa, Artificial Sequence
  GFR-binding peptide
  MOD_RES (14)..(15): Xaa is C or S
FYLMSIANMKTPTXX

SEQ ID NO: 4627 - protein, 11 aa, Artificial Sequence
  GFR-binding peptide
FYLMSIANMKT

SEQ ID NO: 4628 - protein, 10 aa, Artificial Sequence
  GFR-binding peptide
FYLMSIANLE

SEQ ID NO: 4629 - protein, 10 aa, Artificial Sequence
  GFR-binding peptide
FYLISIANLK

SEQ ID NO: 4630 - protein, 19 aa, Artificial Sequence
  GFR-binding peptide
  MOD_RES (14)..(14): Xaa is C or S
FYLVSIANLKTPAXTPKTV

SEQ ID NO: 4631 - protein, 17 aa, Artificial Sequence
  GFR-binding peptide
  MOD_RES (14)..(15): Xaa is C or S
FYLMSIANMKTPTXXPG

SEQ ID NO: 4632 - protein, 16 aa, Artificial Sequence
  GFR-binding peptide
  MOD_RES (14)..(15): Xaa is C or S
FYLVSIANLKTPAXXP

SEQ ID NO: 4633 - protein, 18 aa, Artificial Sequence
  GFR-binding peptide
  MOD_RES (14)..(15): Xaa is C or S
FYLVSIANLKTPAXXAKP

SEQ ID NO: 4634 - protein, 16 aa, Artificial Sequence
  GFR-binding peptide
  MOD_RES (14)..(15): Xaa is C or S
FYLISIANLRTPVXXT

SEQ ID NO: 4635 - protein, 20 aa, Artificial Sequence
  GFR-binding peptide
  MOD_RES (14)..(15): Xaa is C or S
FYLISIANLRTPVXXTPPTS

SEQ ID NO: 4636 - protein, 13 aa, Artificial Sequence
  GFR-binding peptide
FYLVSIANLKTPV

SEQ ID NO: 4637 - protein, 20 aa, Artificial Sequence
  GFR-binding peptide
  MOD_RES (14)..(15): Xaa is C or S
FYLMSIANLETPVXXAKPIK

SEQ ID NO: 4638 - protein, 19 aa, Artificial Sequence
  GFR-binding peptide
  MOD_RES (14)..(15): Xaa is C or S
FYLVSIANLKTPAXXAKPV

SEQ ID NO: 4639 - protein, 13 aa, Artificial Sequence
  GFR-binding peptide
FYLISIANLRTPV

SEQ ID NO: 4640 - protein, 15 aa, Artificial Sequence
  GFR-binding peptide
  MOD_RES (14)..(15): Xaa is C or S
FYLVSIANLQTPAXX

SEQ ID NO: 4641 - protein, 19 aa, Artificial Sequence
  GFR-binding peptide
  MOD_RES (14)..(15): Xaa is C or S
FYLMSIANLETPVXXAKPI

SEQ ID NO: 4642 - protein, 16 aa, Artificial Sequence
  GFR-binding peptide
  MOD_RES (14)..(15): Xaa is C or S
FYLISIANLRAPVXXS

SEQ ID NO: 4643 - protein, 10 aa, Artificial Sequence
  GFR-binding peptide
FYLISIANLR

SEQ ID NO: 4644 - protein, 15 aa, Artificial Sequence
  GFR-binding peptide
  MOD_RES (14)..(15): Xaa is C or S
FYLMSIANLETPVXX

SEQ ID NO: 4645 - protein, 20 aa, Artificial Sequence
  GFR-binding peptide
  MOD_RES (14)..(15): Xaa is C or S
FYLMSIANLETPVXXAKPIS

SEQ ID NO: 4646 - protein, 10 aa, Artificial Sequence
  GFR-binding peptide
FYLVSIANLK

SEQ ID NO: 4647 - protein, 19 aa, Artificial Sequence
  GFR-binding peptide
  MOD_RES (14)..(15): Xaa is C or S
FYLISIANLRAPVXXSAPA

SEQ ID NO: 4648 - protein, 13 aa, Artificial Sequence
  GFR-binding peptide
FYLISIANLKTPV

SEQ ID NO: 4649 - protein, 16 aa, Artificial Sequence
  GFR-binding peptide
  MOD_RES (14)..(15): Xaa is C or S
FYLMSIANLETPVXXA

SEQ ID NO: 4650 - protein, 11 aa, Artificial Sequence
  GFR-binding peptide
FYLISIANLRA

SEQ ID NO: 4651 - protein, 18 aa, Artificial Sequence
  GFR-binding peptide
  MOD_RES (14)..(15): Xaa is C or S
FYLVSIANLQTPAXXPKP

SEQ ID NO: 4652 - protein, 18 aa, Artificial Sequence
  GFR-binding peptide
  MOD_RES (14)..(15): Xaa is C or S
FYLMSIANMKTPTXXPGA

SEQ ID NO: 4653 - protein, 15 aa, Artificial Sequence
  GFR-binding peptide
  MOD_RES (14)..(15): Xaa is C or S
FYLISIANLKTPVXX

SEQ ID NO: 4654 - protein, 20 aa, Artificial Sequence
  GFR-binding peptide
  MOD_RES (14)..(15): Xaa is C or S
FYLISIANLKTPVXXAKSAK

SEQ ID NO: 4655 - protein, 9 aa, Artificial Sequence
  GFR-binding peptide
FYLMSIANL

SEQ ID NO: 4656 - protein, 13 aa, Artificial Sequence
  GFR-binding peptide
FYLVSIANLQTPA

SEQ ID NO: 4657 - protein, 9 aa, Artificial Sequence
  GFR-binding peptide
FYLVSIANL

SEQ ID NO: 4658 - protein, 12 aa, Artificial Sequence
  GFR-binding peptide
FYLVSIANLQTP

SEQ ID NO: 4659 - protein, 13 aa, Artificial Sequence
  GFR-binding peptide
FYLISIANLRAPV

SEQ ID NO: 4660 - protein, 20 aa, Artificial Sequence
  GFR-binding peptide
  MOD_RES (14)..(15): Xaa is C or S
FYLVSIANLKTPAXXPKPVH

SEQ ID NO: 4661 - protein, 13 aa, Artificial Sequence
  GFR-binding peptide
FYLMSIANLETPV

SEQ ID NO: 4662 - protein, 16 aa, Artificial Sequence
  GFR-binding peptide
  MOD_RES (14)..(15): Xaa is C or S
FYLVSIANLKTPAXXA

SEQ ID NO: 4663 - protein, 16 aa, Artificial Sequence
  GFR-binding peptide
  MOD_RES (14)..(15): Xaa is C or S
FYLISIANLKTPVXXA

SEQ ID NO: 4664 - protein, 19 aa, Artificial Sequence
  GFR-binding peptide
  MOD_RES (14)..(15): Xaa is C or S
FYLMSIANMKTPTXXPGAS

SEQ ID NO: 4665 - protein, 18 aa, Artificial Sequence
  GFR-binding peptide
  MOD_RES (14)..(15): Xaa is C or S
FYLISIANLKTPVXXAKS

SEQ ID NO: 4666 - protein, 20 aa, Artificial Sequence
  GFR-binding peptide
  MOD_RES (14)..(15): Xaa is C or S
FYLMSIANMKTPTXXPGASG

SEQ ID NO: 4667 - protein, 15 aa, Artificial Sequence
  GFR-binding peptide
  MOD_RES (14)..(15): Xaa is C or S
FYLVSIANLKTPVXX

SEQ ID NO: 4668 - protein, 10 aa, Artificial Sequence
  GFR-binding peptide
FYLMSIANMK

SEQ ID NO: 4669 - protein, 16 aa, Artificial Sequence
  GFR-binding peptide
  MOD_RES (14)..(14): Xaa is C or S
FYLVSIANLKTPAXTP

SEQ ID NO: 4670 - protein, 15 aa, Artificial Sequence
  GFR-binding peptide
  MOD_RES (14)..(15): Xaa is C or S
FYLISIANLRTPVXX

SEQ ID NO: 4671 - protein, 10 aa, Artificial Sequence
  GFR-binding peptide
FYLMSIANTK

SEQ ID NO: 4672 - protein, 11 aa, Artificial Sequence
  GFR-binding peptide
FYLISIANLRT

SEQ ID NO: 4673 - protein, 17 aa, Artificial Sequence
  GFR-binding peptide
  MOD_RES (14)..(15): Xaa is C or S
FYLVSIANLQTPAXXPK

SEQ ID NO: 4674 - protein, 11 aa, Artificial Sequence
  GFR-binding peptide
FYLVSIANLKT

SEQ ID NO: 4675 - protein, 19 aa, Artificial Sequence
  GFR-binding peptide
  MOD_RES (14)..(15): Xaa is C or S
FYLVSIANLQTPAXXPKPV

SEQ ID NO: 4676 - protein, 19 aa, Artificial Sequence
  GFR-binding peptide
  MOD_RES (14)..(15): Xaa is C or S
FYLVSIANLKTPVXXAKGV

SEQ ID NO: 4677 - protein, 17 aa, Artificial Sequence
  GFR-binding peptide
  MOD_RES (14)..(15): Xaa is C or S
FYLISIANLRAPVXXSA

SEQ ID NO: 4678 - protein, 14 aa, Artificial Sequence
  GFR-binding peptide
  MOD_RES (14)..(14): Xaa is C or S
FYLISIANLRAPVX

SEQ ID NO: 4679 - protein, 14 aa, Artificial Sequence
  GFR-binding peptide
  MOD_RES (14)..(14): Xaa is C or S
FYLMSIANLETPVX

SEQ ID NO: 4680 - protein, 16 aa, Artificial Sequence
  GFR-binding peptide
  MOD_RES (14)..(15): Xaa is C or S
FYLVSIANLKTPVXXA

SEQ ID NO: 4681 - protein, 17 aa, Artificial Sequence
  GFR-binding peptide
  MOD_RES (14)..(15): Xaa is C or S
FYLVSIANLKTPAXXPK

SEQ ID NO: 4682 - protein, 11 aa, Artificial Sequence
  GFR-binding peptide
FYLVSIANLQT

SEQ ID NO: 4683 - protein, 8 aa, Artificial Sequence
  GFR-binding peptide
FYLVSIAN

SEQ ID NO: 4684 - protein, 13 aa, Artificial Sequence
  GFR-binding peptide
FYLMSIANMKTPT

SEQ ID NO: 4685 - protein, 18 aa, Artificial Sequence
  GFR-binding peptide
  MOD_RES (14)..(15): Xaa is C or S
FYLMSIANTKVPAXXTSP

SEQ ID NO: 4686 - protein, 16 aa, Artificial Sequence
  GFR-binding peptide
  MOD_RES (14)..(15): Xaa is C or S
FYLVSIANLQTPAXXP

SEQ ID NO: 4687 - protein, 20 aa, Artificial Sequence
  GFR-binding peptide
  MOD_RES (14)..(15): Xaa is C or S
FYLMSIANTKVPAXXTSPVR

SEQ ID NO: 4688 - protein, 19 aa, Artificial Sequence
  GFR-binding peptide
  MOD_RES (14)..(15): Xaa is C or S
FYLVSIANLKTPAXXPKPV

SEQ ID NO: 4689 - protein, 20 aa, Artificial Sequence
  GFR-binding peptide
  MOD_RES (14)..(15): Xaa is C or S
FYLVSIANLQTPAXXPKPVT

SEQ ID NO: 4690 - protein, 19 aa, Artificial Sequence
  GFR-binding peptide
  MOD_RES (14)..(15): Xaa is C or S
FYLISIANLKTPVXXAKSA

SEQ ID NO: 4691 - protein, 18 aa, Artificial Sequence
  GFR-binding peptide
  MOD_RES (14)..(15): Xaa is C or S
FYLISIANLRAPVXXSAP

SEQ ID NO: 4692 - protein, 14 aa, Artificial Sequence
  GFR-binding peptide
  MOD_RES (14)..(14): Xaa is C or S
FYLVSIANLKTPVX

SEQ ID NO: 4693 - protein, 14 aa, Artificial Sequence
  GFR-binding peptide
  MOD_RES (14)..(14): Xaa is C or S
FYLISIANLRTPVX

SEQ ID NO: 4694 - protein, 16 aa, Artificial Sequence
  GFR-binding peptide
  MOD_RES (14)..(15): Xaa is C or S
FYLMSIANTKVPAXXT

SEQ ID NO: 4695 - protein, 12 aa, Artificial Sequence
  GFR-binding peptide
FYLISIANLKTP

SEQ ID NO: 4696 - protein, 14 aa, Artificial Sequence
  GFR-binding peptide
  MOD_RES (14)..(14): Xaa is C or S
FYLMSIANTKVPAX

SEQ ID NO: 4697 - protein, 18 aa, Artificial Sequence
  GFR-binding peptide
  MOD_RES (14)..(15): Xaa is C or S
FYLMSIANLETPVXXAKP

SEQ ID NO: 4698 - protein, 17 aa, Artificial Sequence
  GFR-binding peptide
  MOD_RES (14)..(14): Xaa is C or S
FYLVSIANLKTPAXTPK

SEQ ID NO: 4699 - protein, 18 aa, Artificial Sequence
  GFR-binding peptide
  MOD_RES (14)..(14): Xaa is C or S
FYLVSIANLKTPAXTPKT

SEQ ID NO: 4700 - protein, 12 aa, Artificial Sequence
  GFR-binding peptide
FYLMSIANTKVP

SEQ ID NO: 4701 - protein, 13 aa, Artificial Sequence
  GFR-binding peptide
FYLMSIANTKVPA

SEQ ID NO: 4702 - protein, 14 aa, Artificial Sequence
  GFR-binding peptide
  MOD_RES (14)..(14): Xaa is C or S
FYLMSIANMKTPTX

SEQ ID NO: 4703 - protein, 15 aa, Artificial Sequence
  GFR-binding peptide
  MOD_RES (14)..(15): Xaa is C or S
FYLVSIANLKTPAXX

SEQ ID NO: 4704 - protein, 19 aa, Artificial Sequence
  GFR-binding peptide
  MOD_RES (14)..(15): Xaa is C or S
FYLMSIANTKVPAXXTSPV

SEQ ID NO: 4705 - protein, 17 aa, Artificial Sequence
  GFR-binding peptide
  MOD_RES (14)..(15): Xaa is C or S
FYLISIANLKTPVXXAK

SEQ ID NO: 4706 - protein, 18 aa, Artificial Sequence
  GFR-binding peptide
  MOD_RES (14)..(15): Xaa is C or S
FYLVSIANLKTPVXXAKG

SEQ ID NO: 4707 - protein, 17 aa, Artificial Sequence
  GFR-binding peptide
  MOD_RES (14)..(15): Xaa is C or S
FYLISIANLRTPVXXTP

SEQ ID NO: 4708 - protein, 15 aa, Artificial Sequence
  GFR-binding peptide
  MOD_RES (14)..(15): Xaa is C or S
FYLISIANLRAPVXX

SEQ ID NO: 4709 - protein, 11 aa, Artificial Sequence
  GFR-binding peptide
FYLMSIANTKV

SEQ ID NO: 4710 - protein, 17 aa, Artificial Sequence
  GFR-binding peptide
  MOD_RES (14)..(15): Xaa is C or S
FYLMSIANLETPVXXAK

SEQ ID NO: 4711 - protein, 12 aa, Artificial Sequence
  GFR-binding peptide
FYLMSIANMKTP

SEQ ID NO: 4712 - protein, 12 aa, Artificial Sequence
  GFR-binding peptide
FYLISIANLRTP

SEQ ID NO: 4713 - protein, 11 aa, Artificial Sequence
  GFR-binding peptide
FYLISIANLKT

SEQ ID NO: 4714 - protein, 18 aa, Artificial Sequence
  GFR-binding peptide
  MOD_RES (14)..(15): Xaa is C or S
FYLVSIANLKTPAXXPKP

SEQ ID NO: 4715 - protein, 12 aa, Artificial Sequence
  GFR-binding peptide
FYLVSIANLKTP

SEQ ID NO: 4716 - protein, 11 aa, Artificial Sequence
  GFR-binding peptide
FYLMSIANLET

SEQ ID NO: 4717 - protein, 17 aa, Artificial Sequence
  GFR-binding peptide
  MOD_RES (14)..(15): Xaa is C or S
FYLMSIANTKVPAXXTS

SEQ ID NO: 4718 - protein, 9 aa, Artificial Sequence
  GFR-binding peptide
FYLISIANL

SEQ ID NO: 4719 - protein, 13 aa, Artificial Sequence
  GFR-binding peptide
VPQDLEPISILYL

SEQ ID NO: 4720 - protein, 13 aa, Artificial Sequence
  GFR-binding peptide
VPTRLSATSILYY

SEQ ID NO: 4721 - protein, 14 aa, Artificial Sequence
  GFR-binding peptide
  MOD_RES (1)..(1): Xaa is C or S
XVPTKLNAISILYF

SEQ ID NO: 4722 - protein, 13 aa, Artificial Sequence
  GFR-binding peptide
VPTELEPISMLYL

SEQ ID NO: 4723 - protein, 19 aa, Artificial Sequence
  GFR-binding peptide
  MOD_RES (5)..(6): Xaa is C or S
APASXXVPARLSPISILYK

SEQ ID NO: 4724 - protein, 14 aa, Artificial Sequence
  GFR-binding peptide
  MOD_RES (1)..(1): Xaa is C or S
XVSQDLEPISILYL

SEQ ID NO: 4725 - protein, 11 aa, Artificial Sequence
  GFR-binding peptide
QDLNAISILYF

SEQ ID NO: 4726 - protein, 14 aa, Artificial Sequence
  GFR-binding peptide
  MOD_RES (1)..(1): Xaa is C or S
XVPEKMSATSILYY

SEQ ID NO: 4727 - protein, 17 aa, Artificial Sequence
  GFR-binding peptide
  MOD_RES (3)..(4): Xaa is C or S
KAXXAPTKLSPINVLYF

SEQ ID NO: 4728 - protein, 10 aa, Artificial Sequence
  GFR-binding peptide
QLSPINVLYF

SEQ ID NO: 4729 - protein, 15 aa, Artificial Sequence
  GFR-binding peptide
  MOD_RES (1)..(2): Xaa is C or S
XXVPTELSPINMLYF

SEQ ID NO: 4730 - protein, 16 aa, Artificial Sequence
  GFR-binding peptide
  MOD_RES (2)..(3): Xaa is C or S
TXXVPTRLSPINILYF

SEQ ID NO: 4731 - protein, 18 aa, Artificial Sequence
  GFR-binding peptide
  MOD_RES (4)..(5): Xaa is C or S
PEPXXVPEKMSPINILYF

SEQ ID NO: 4732 - protein, 20 aa, Artificial Sequence
  GFR-binding peptide
  MOD_RES (6)..(7): Xaa is C or S
GSAGPXXTPTKMSPISMLYK

SEQ ID NO: 4733 - protein, 16 aa, Artificial Sequence
  GFR-binding peptide
  MOD_RES (3)..(3): Xaa is C or S
PTXAPTKLEPISVLYL

SEQ ID NO: 4734 - protein, 16 aa, Artificial Sequence
  GFR-binding peptide
  MOD_RES (2)..(3): Xaa is C or S
PXXAPTQLSATSVLYY

SEQ ID NO: 4735 - protein, 10 aa, Artificial Sequence
  GFR-binding peptide
DLEPISILYL

SEQ ID NO: 4736 - protein, 11 aa, Artificial Sequence
  GFR-binding peptide
TKMSPISMLYK

SEQ ID NO: 4737 - protein, 16 aa, Artificial Sequence
  GFR-binding peptide
  MOD_RES (2)..(3): Xaa is C or S
PXXVPQALSATSILYY

SEQ ID NO: 4738 - protein, 12 aa, Artificial Sequence
  GFR-binding peptide
PQALSPISILYK

SEQ ID NO: 4739 - protein, 14 aa, Artificial Sequence
  GFR-binding peptide
  MOD_RES (1)..(1): Xaa is C or S
XVPTKLSPISILYK

SEQ ID NO: 4740 - protein, 11 aa, Artificial Sequence
  GFR-binding peptide
TKMNAISMLYF

SEQ ID NO: 4741 - protein, 20 aa, Artificial Sequence
  GFR-binding peptide
  MOD_RES (6)..(7): Xaa is C or S
KVGKAXXVPTKLSPINVLYF

SEQ ID NO: 4742 - protein, 9 aa, Artificial Sequence
  GFR-binding peptide
MSPISILYK

SEQ ID NO: 4743 - protein, 18 aa, Artificial Sequence
  GFR-binding peptide
  MOD_RES (4)..(5): Xaa is C or S
ASPXXVPQDLSATSILYY

SEQ ID NO: 4744 - protein, 18 aa, Artificial Sequence
  GFR-binding peptide
  MOD_RES (4)..(5): Xaa is C or S
AAPXXVPQALSATSILYY

SEQ ID NO: 4745 - protein, 18 aa, Artificial Sequence
  GFR-binding peptide
  MOD_RES (5)..(5): Xaa is C or S
TKPTXAPTKLSPINVLYF

SEQ ID NO: 4746 - protein, 18 aa, Artificial Sequence
  GFR-binding peptide
  MOD_RES (4)..(5): Xaa is C or S
PKAXXAPTKLNAISVLYF

SEQ ID NO: 4747 - protein, 11 aa, Artificial Sequence
  GFR-binding peptide
TRLEPISILYL

SEQ ID NO: 4748 - protein, 19 aa, Artificial Sequence
  GFR-binding peptide
  MOD_RES (5)..(6): Xaa is C or S
VPSTXXAPVKTSATSMLYY

SEQ ID NO: 4749 - protein, 12 aa, Artificial Sequence
  GFR-binding peptide
PVKTSPINMLYF

SEQ ID NO: 4750 - protein, 17 aa, Artificial Sequence
  GFR-binding peptide
  MOD_RES (3)..(4): Xaa is C or S
SPXXVSQDLEPISILYL

SEQ ID NO: 4751 - protein, 16 aa, Artificial Sequence
  GFR-binding peptide
  MOD_RES (2)..(3): Xaa is C or S
PXXVPEKMSPISILYK

SEQ ID NO: 4752 - protein, 17 aa, Artificial Sequence
  GFR-binding peptide
  MOD_RES (3)..(4): Xaa is C or S
KPXXAPTQLSPINVLYF

SEQ ID NO: 4753 - protein, 16 aa, Artificial Sequence
  GFR-binding peptide
  MOD_RES (2)..(3): Xaa is C or S
SXXVPARLNAISILYF

SEQ ID NO: 4754 - protein, 9 aa, Artificial Sequence
  GFR-binding peptide
LEPISVLYL

SEQ ID NO: 4755 - protein, 18 aa, Artificial Sequence
  GFR-binding peptide
  MOD_RES (4)..(5): Xaa is C or S
PSTXXAPVKTSPINMLYF

SEQ ID NO: 4756 - protein, 19 aa, Artificial Sequence
  GFR-binding peptide
  MOD_RES (5)..(6): Xaa is C or S
APASXXVPARLNAISILYF

SEQ ID NO: 4757 - protein, 12 aa, Artificial Sequence
  GFR-binding peptide
PTQLSPISVLYK

SEQ ID NO: 4758 - protein, 17 aa, Artificial Sequence
  GFR-binding peptide
  MOD_RES (4)..(4): Xaa is C or S
KPTXAPTKLEPISVLYL

SEQ ID NO: 4759 - protein, 16 aa, Artificial Sequence
  GFR-binding peptide
  MOD_RES (2)..(3): Xaa is C or S
SXXVPARLSPISILYK

SEQ ID NO: 4760 - protein, 15 aa, Artificial Sequence
  GFR-binding peptide
  MOD_RES (1)..(2): Xaa is C or S
XXVPARLSATSILYY

SEQ ID NO: 4761 - protein, 12 aa, Artificial Sequence
  GFR-binding peptide
PTKMEPISMLYL

SEQ ID NO: 4762 - protein, 17 aa, Artificial Sequence
  GFR-binding peptide
  MOD_RES (3)..(4): Xaa is C or S
KAXXAPTKLEPISVLYL

SEQ ID NO: 4763 - protein, 14 aa, Artificial Sequence
  GFR-binding peptide
  MOD_RES (1)..(1): Xaa is C or S
XVPARLSATSILYY

SEQ ID NO: 4764 - protein, 14 aa, Artificial Sequence
  GFR-binding peptide
  MOD_RES (1)..(1): Xaa is C or S
XVPQDLSPINILYF

SEQ ID NO: 4765 - protein, 20 aa, Artificial Sequence
  GFR-binding peptide
  MOD_RES (6)..(7): Xaa is C or S
GSAGPXXTPTKMNAISMLYF

SEQ ID NO: 4766 - protein, 9 aa, Artificial Sequence
  GFR-binding peptide
LSPINVLYF

SEQ ID NO: 4767 - protein, 15 aa, Artificial Sequence
  GFR-binding peptide
  MOD_RES (1)..(2): Xaa is C or S
XXVPTELEPISMLYL

SEQ ID NO: 4768 - protein, 16 aa, Artificial Sequence
  GFR-binding peptide
  MOD_RES (3)..(3): Xaa is C or S
PTXAPTKLSPINVLYF

SEQ ID NO: 4769 - protein, 17 aa, Artificial Sequence
  GFR-binding peptide
  MOD_RES (3)..(4): Xaa is C or S
APXXVPQALSPINILYF

SEQ ID NO: 4770 - protein, 15 aa, Artificial Sequence
  GFR-binding peptide
  MOD_RES (1)..(2): Xaa is C or S
XXVPQDLEPISILYL

SEQ ID NO: 4771 - protein, 9 aa, Artificial Sequence
  GFR-binding peptide
MNAISILYF

SEQ ID NO: 4772 - protein, 14 aa, Artificial Sequence
  GFR-binding peptide
  MOD_RES (1)..(1): Xaa is C or S
XAPTQLEPISVLYL

SEQ ID NO: 4773 - protein, 17 aa, Artificial Sequence
  GFR-binding peptide
  MOD_RES (3)..(4): Xaa is C or S
GPXXTPTKMSATSMLYY

SEQ ID NO: 4774 - protein, 11 aa, Artificial Sequence
  GFR-binding peptide
QDLSPISILYK

SEQ ID NO: 4775 - protein, 19 aa, Artificial Sequence
  GFR-binding peptide
  MOD_RES (5)..(6): Xaa is C or S
SAAPXXVPQALEPISILYL

SEQ ID NO: 4776 - protein, 18 aa, Artificial Sequence
  GFR-binding peptide
  MOD_RES (4)..(5): Xaa is C or S
PASXXVPARLSPINILYF

SEQ ID NO: 4777 - protein, 17 aa, Artificial Sequence
  GFR-binding peptide
  MOD_RES (3)..(4): Xaa is C or S
SPXXVPQDLSPINILYF

SEQ ID NO: 4778 - protein, 15 aa, Artificial Sequence
  GFR-binding peptide
  MOD_RES (1)..(2): Xaa is C or S
XXTPTKMEPISMLYL

SEQ ID NO: 4779 - protein, 13 aa, Artificial Sequence
  GFR-binding peptide
TPTKMEPISMLYL

SEQ ID NO: 4780 - protein, 15 aa, Artificial Sequence
  GFR-binding peptide
  MOD_RES (2)..(2): Xaa is C or S
TXAPTKLSATSVLYY

SEQ ID NO: 4781 - protein, 11 aa, Artificial Sequence
  GFR-binding peptide
TELSPISMLYK

SEQ ID NO: 4782 - protein, 16 aa, Artificial Sequence
  GFR-binding peptide
  MOD_RES (2)..(3): Xaa is C or S
PXXAPTKLEPISVLYL

SEQ ID NO: 4783 - protein, 11 aa, Artificial Sequence
  GFR-binding peptide
TKLSPINVLYF

SEQ ID NO: 4784 - protein, 20 aa, Artificial Sequence
  GFR-binding peptide
  MOD_RES (6)..(7): Xaa is C or S
SIPKAXXVPTELSATSMLYY

SEQ ID NO: 4785 - protein, 17 aa, Artificial Sequence
  GFR-binding peptide
  MOD_RES (3)..(4): Xaa is C or S
KAXXVPTELNAISMLYF

SEQ ID NO: 4786 - protein, 9 aa, Artificial Sequence
  GFR-binding peptide
LEPISMLYL

SEQ ID NO: 4787 - protein, 19 aa, Artificial Sequence
  GFR-binding peptide
  MOD_RES (5)..(6): Xaa is C or S
SASPXXVPQDLEPISILYL

SEQ ID NO: 4788 - protein, 20 aa, Artificial Sequence
  GFR-binding peptide
  MOD_RES (6)..(7): Xaa is C or S
KVGKAXXVPTKLEPISVLYL

SEQ ID NO: 4789 - protein, 11 aa, Artificial Sequence
  GFR-binding peptide
TELNAISMLYF

SEQ ID NO: 4790 - protein, 17 aa, Artificial Sequence
  GFR-binding peptide
  MOD_RES (3)..(4): Xaa is C or S
KAXXVPTKLSPINVLYF

SEQ ID NO: 4791 - protein, 17 aa, Artificial Sequence
  GFR-binding peptide
  MOD_RES (3)..(4): Xaa is C or S
KAXXVPTELSPISMLYK

SEQ ID NO: 4792 - protein, 17 aa, Artificial Sequence
  GFR-binding peptide
  MOD_RES (3)..(4): Xaa is C or S
APXXVPQALEPISILYL

SEQ ID NO: 4793 - protein, 16 aa, Artificial Sequence
  GFR-binding peptide
  MOD_RES (2)..(3): Xaa is C or S
AXXVPTELSPINMLYF

SEQ ID NO: 4794 - protein, 15 aa, Artificial Sequence
  GFR-binding peptide
  MOD_RES (1)..(2): Xaa is C or S
XXAPVKTSATSMLYY

SEQ ID NO: 4795 - protein, 19 aa, Artificial Sequence
  GFR-binding peptide
  MOD_RES (5)..(6): Xaa is C or S
SASPXXVPQDLSPINILYF

SEQ ID NO: 4796 - protein, 20 aa, Artificial Sequence
  GFR-binding peptide
  MOD_RES (6)..(7): Xaa is C or S
GIPEPXXVPEKMSATSILYY

SEQ ID NO: 4797 - protein, 10 aa, Artificial Sequence
  GFR-binding peptide
KTEPISMLYL

SEQ ID NO: 4798 - protein, 14 aa, Artificial Sequence
  GFR-binding peptide
  MOD_RES (1)..(1): Xaa is C or S
XVPQALSPINILYF

SEQ ID NO: 4799 - protein, 10 aa, Artificial Sequence
  GFR-binding peptide
KTSPISMLYK

SEQ ID NO: 4800 - protein, 17 aa, Artificial Sequence
  GFR-binding peptide
  MOD_RES (3)..(4): Xaa is C or S
PTXXVPTRLSATSILYY

SEQ ID NO: 4801 - protein, 18 aa, Artificial Sequence
  GFR-binding peptide
  MOD_RES (4)..(5): Xaa is C or S
PSTXXAPVKTEPISMLYL

SEQ ID NO: 4802 - protein, 20 aa, Artificial Sequence
  GFR-binding peptide
  MOD_RES (6)..(7): Xaa is C or S
TVPKPXXAPTQLEPISVLYL

SEQ ID NO: 4803 - protein, 20 aa, Artificial Sequence
  GFR-binding peptide
  MOD_RES (6)..(7): Xaa is C or S
AAPASXXVPARLSATSILYY

SEQ ID NO: 4804 - protein, 11 aa, Artificial Sequence
  GFR-binding peptide
ARLSPINILYF

SEQ ID NO: 4805 - protein, 19 aa, Artificial Sequence
  GFR-binding peptide
  MOD_RES (5)..(6): Xaa is C or S
VPKPXXAPTQLEPISVLYL

SEQ ID NO: 4806 - protein, 9 aa, Artificial Sequence
  GFR-binding peptide
MNAISMLYF

SEQ ID NO: 4807 - protein, 16 aa, Artificial Sequence
  GFR-binding peptide
  MOD_RES (2)..(3): Xaa is C or S
TXXAPVKTSPINMLYF

SEQ ID NO: 4808 - protein, 19 aa, Artificial Sequence
  GFR-binding peptide
  MOD_RES (5)..(6): Xaa is C or S
SASPXXVSQDLSPISILYK

SEQ ID NO: 4809 - protein, 18 aa, Artificial Sequence
  GFR-binding peptide
  MOD_RES (4)..(5): Xaa is C or S
ASPXXVSQDLSPINILYF

SEQ ID NO: 4810 - protein, 18 aa, Artificial Sequence
  GFR-binding peptide
  MOD_RES (4)..(5): Xaa is C or S
PPTXXVPTRLSPISILYK

SEQ ID NO: 4811 - protein, 12 aa, Artificial Sequence
  GFR-binding peptide
PVKTEPISMLYL

SEQ ID NO: 4812 - protein, 16 aa, Artificial Sequence
  GFR-binding peptide
  MOD_RES (2)..(3): Xaa is C or S
PXXAPTKLSPINVLYF

SEQ ID NO: 4813 - protein, 19 aa, Artificial Sequence
  GFR-binding peptide
  MOD_RES (5)..(6): Xaa is C or S
VPKAXXAPTKLSPINVLYF

SEQ ID NO: 4814 - protein, 16 aa, Artificial Sequence
  GFR-binding peptide
  MOD_RES (2)..(3): Xaa is C or S
PXXTPTKMSPISMLYK

SEQ ID NO: 4815 - protein, 11 aa, Artificial Sequence
  GFR-binding peptide
QALSATSILYY

SEQ ID NO: 4816 - protein, 20 aa, Artificial Sequence
  GFR-binding peptide
  MOD_RES (6)..(7): Xaa is C or S
KIPKAXXVPTELNAISMLYF

SEQ ID NO: 4817 - protein, 11 aa, Artificial Sequence
  GFR-binding peptide
TKLEPISVLYL

SEQ ID NO: 4818 - protein, 12 aa, Artificial Sequence
  GFR-binding peptide
PQDLSPINILYF

SEQ ID NO: 4819 - protein, 14 aa, Artificial Sequence
  GFR-binding peptide
  MOD_RES (1)..(1): Xaa is C or S
XVPTRLSATSILYY

SEQ ID NO: 4820 - protein, 13 aa, Artificial Sequence
  GFR-binding peptide
APVKTSATSMLYY

SEQ ID NO: 4821 - protein, 12 aa, Artificial Sequence
  GFR-binding peptide
PTRLSATSILYY

SEQ ID NO: 4822 - protein, 10 aa, Artificial Sequence
  GFR-binding peptide
RLNAISILYF

SEQ ID NO: 4823 - protein, 12 aa, Artificial Sequence
  GFR-binding peptide
SQDLNAISILYF

SEQ ID NO: 4824 - protein, 10 aa, Artificial Sequence
  GFR-binding peptide
ALNAISILYF

SEQ ID NO: 4825 - protein, 13 aa, Artificial Sequence
  GFR-binding peptide
VPTKLNAISILYF

SEQ ID NO: 4826 - protein, 14 aa, Artificial Sequence
  GFR-binding peptide
  MOD_RES (1)..(1): Xaa is C or S
XTPTKMEPISMLYL

SEQ ID NO: 4827 - protein, 18 aa, Artificial Sequence
  GFR-binding peptide
  MOD_RES (4)..(5): Xaa is C or S
AGPXXTPTKMNAISMLYF

SEQ ID NO: 4828 - protein, 15 aa, Artificial Sequence
  GFR-binding peptide
  MOD_RES (1)..(2): Xaa is C or S
XXVPTKLNAISILYF

SEQ ID NO: 4829 - protein, 15 aa, Artificial Sequence
  GFR-binding peptide
  MOD_RES (1)..(2): Xaa is C or S
XXVPQALNAISILYF

SEQ ID NO: 4830 - protein, 13 aa, Artificial Sequence
  GFR-binding peptide
VPQALNAISILYF

SEQ ID NO: 4831 - protein, 18 aa, Artificial Sequence
  GFR-binding peptide
  MOD_RES (4)..(5): Xaa is C or S
PKPXXAPTKLSPINVLYF

SEQ ID NO: 4832 - protein, 12 aa, Artificial Sequence
  GFR-binding peptide
PTELSPISMLYK

SEQ ID NO: 4833 - protein, 14 aa, Artificial Sequence
  GFR-binding peptide
  MOD_RES (1)..(1): Xaa is C or S
XVPTELSATSMLYY

SEQ ID NO: 4834 - protein, 9 aa, Artificial Sequence
  GFR-binding peptide
LSPISMLYK

SEQ ID NO: 4835 - protein, 16 aa, Artificial Sequence
  GFR-binding peptide
  MOD_RES (2)..(3): Xaa is C or S
PXXVPQDLSATSILYY

SEQ ID NO: 4836 - protein, 10 aa, Artificial Sequence
  GFR-binding peptide
KLSPISILYK

SEQ ID NO: 4837 - protein, 18 aa, Artificial Sequence
  GFR-binding peptide
  MOD_RES (4)..(5): Xaa is C or S
SKAXXVPTKLSATSILYY

SEQ ID NO: 4838 - protein, 11 aa, Artificial Sequence
  GFR-binding peptide
ARLEPISILYL

SEQ ID NO: 4839 - protein, 18 aa, Artificial Sequence
  GFR-binding peptide
  MOD_RES (4)..(5): Xaa is C or S
GKAXXVPTKLSATSVLYY

SEQ ID NO: 4840 - protein, 16 aa, Artificial Sequence
  GFR-binding peptide
  MOD_RES (2)..(3): Xaa is C or S
PXXVPEKMNAISILYF

SEQ ID NO: 4841 - protein, 16 aa, Artificial Sequence
  GFR-binding peptide
  MOD_RES (2)..(3): Xaa is C or S
PXXVSQDLSATSILYY

SEQ ID NO: 4842 - protein, 20 aa, Artificial Sequence
  GFR-binding peptide
  MOD_RES (6)..(7): Xaa is C or S
STPPTXXVPTRLSPISILYK

SEQ ID NO: 4843 - protein, 20 aa, Artificial Sequence
  GFR-binding peptide
  MOD_RES (6)..(7): Xaa is C or S
ASASPXXVPQDLSPISILYK

SEQ ID NO: 4844 - protein, 15 aa, Artificial Sequence
  GFR-binding peptide
  MOD_RES (1)..(2): Xaa is C or S
XXVPTRLSATSILYY

SEQ ID NO: 4845 - protein, 14 aa, Artificial Sequence
  GFR-binding peptide
  MOD_RES (1)..(1): Xaa is C or S
XVSQDLSPINILYF

SEQ ID NO: 4846 - protein, 17 aa, Artificial Sequence
  GFR-binding peptide
  MOD_RES (3)..(4): Xaa is C or S
KAXXVPTKLEPISVLYL

SEQ ID NO: 4847 - protein, 19 aa, Artificial Sequence
  GFR-binding peptide
  MOD_RES (5)..(6): Xaa is C or S
VGKAXXVPTKLNAISVLYF

SEQ ID NO: 4848 - protein, 14 aa, Artificial Sequence
  GFR-binding peptide
  MOD_RES (1)..(1): Xaa is C or S
XVPQALEPISILYL

SEQ ID NO: 4849 - protein, 10 aa, Artificial Sequence
  GFR-binding peptide
KMSATSMLYY

SEQ ID NO: 4850 - protein, 17 aa, Artificial Sequence
  GFR-binding peptide
  MOD_RES (3)..(4): Xaa is C or S
EPXXVPEKMNAISILYF

SEQ ID NO: 4851 - protein, 11 aa, Artificial Sequence
  GFR-binding peptide
TKLSPINILYF

SEQ ID NO: 4852 - protein, 9 aa, Artificial Sequence
  GFR-binding peptide
LSPINILYF

SEQ ID NO: 4853 - protein, 14 aa, Artificial Sequence
  GFR-binding peptide
  MOD_RES (1)..(1): Xaa is C or S
XAPVKTSATSMLYY

SEQ ID NO: 4854 - protein, 18 aa, Artificial Sequence
  GFR-binding peptide
  MOD_RES (5)..(5): Xaa is C or S
TKPTXAPTKLEPISVLYL

SEQ ID NO: 4855 - protein, 16 aa, Artificial Sequence
  GFR-binding peptide
  MOD_RES (2)..(3): Xaa is C or S
TXXAPVKTEPISMLYL

SEQ ID NO: 4856 - protein, 20 aa, Artificial Sequence
  GFR-binding peptide
  MOD_RES (6)..(7): Xaa is C or S
ASAAPXXVPQALNAISILYF

SEQ ID NO: 4857 - protein, 15 aa, Artificial Sequence
  GFR-binding peptide
  MOD_RES (1)..(2): Xaa is C or S
XXVPQDLSPINILYF

SEQ ID NO: 4858 - protein, 19 aa, Artificial Sequence
  GFR-binding peptide
  MOD_RES (5)..(6): Xaa is C or S
IPEPXXVPEKMSPISILYK

SEQ ID NO: 4859 - protein, 17 aa, Artificial Sequence
  GFR-binding peptide
  MOD_RES (3)..(4): Xaa is C or S
KPXXAPTQLEPISVLYL

SEQ ID NO: 4860 - protein, 16 aa, Artificial Sequence
  GFR-binding peptide
  MOD_RES (2)..(3): Xaa is C or S
TXXAPVKTNAISMLYF

SEQ ID NO: 4861 - protein, 12 aa, Artificial Sequence
  GFR-binding peptide
PQDLEPISILYL

SEQ ID NO: 4862 - protein, 19 aa, Artificial Sequence
  GFR-binding peptide
  MOD_RES (5)..(6): Xaa is C or S
TPPTXXVPTRLSATSILYY

SEQ ID NO: 4863 - protein, 20 aa, Artificial Sequence
  GFR-binding peptide
  MOD_RES (6)..(7): Xaa is C or S
RVPSTXXAPVKTSATSMLYY

SEQ ID NO: 4864 - protein, 12 aa, Artificial Sequence
  GFR-binding peptide
PQALNAISILYF

SEQ ID NO: 4865 - protein, 11 aa, Artificial Sequence
  GFR-binding peptide
EKMEPISILYL

SEQ ID NO: 4866 - protein, 17 aa, Artificial Sequence
  GFR-binding peptide
  MOD_RES (3)..(4): Xaa is C or S
KAXXVPTKLSPINILYF

SEQ ID NO: 4867 - protein, 17 aa, Artificial Sequence
  GFR-binding peptide
  MOD_RES (3)..(4): Xaa is C or S
ASXXVPARLSATSILYY

SEQ ID NO: 4868 - protein, 18 aa, Artificial Sequence
  GFR-binding peptide
  MOD_RES (4)..(5): Xaa is C or S
PEPXXVPEKMEPISILYL

SEQ ID NO: 4869 - protein, 16 aa, Artificial Sequence
  GFR-binding peptide
  MOD_RES (2)..(3): Xaa is C or S
AXXVPTELEPISMLYL

SEQ ID NO: 4870 - protein, 9 aa, Artificial Sequence
  GFR-binding peptide
TSPINMLYF

SEQ ID NO: 4871 - protein, 10 aa, Artificial Sequence
  GFR-binding peptide
ELSATSMLYY

SEQ ID NO: 4872 - protein, 13 aa, Artificial Sequence
  GFR-binding peptide
APTQLEPISVLYL

SEQ ID NO: 4873 - protein, 14 aa, Artificial Sequence
  GFR-binding peptide
  MOD_RES (1)..(1): Xaa is C or S
XVPQDLEPISILYL

SEQ ID NO: 4874 - protein, 19 aa, Artificial Sequence
  GFR-binding peptide
  MOD_RES (5)..(6): Xaa is C or S
VPKAXXAPTKLEPISVLYL

SEQ ID NO: 4875 - protein, 15 aa, Artificial Sequence
  GFR-binding peptide
  MOD_RES (1)..(2): Xaa is C or S
XXAPTQLEPISVLYL

SEQ ID NO: 4876 - protein, 16 aa, Artificial Sequence
  GFR-binding peptide
  MOD_RES (2)..(3): Xaa is C or S
PXXTPTKMSATSMLYY

SEQ ID NO: 4877 - protein, 16 aa, Artificial Sequence
  GFR-binding peptide
  MOD_RES (2)..(3): Xaa is C or S
TXXVPTRLEPISILYL

SEQ ID NO: 4878 - protein, 13 aa, Artificial Sequence
  GFR-binding peptide
VPQDLSPINILYF

SEQ ID NO: 4879 - protein, 10 aa, Artificial Sequence
  GFR-binding peptide
DLSPINILYF

SEQ ID NO: 4880 - protein, 12 aa, Artificial Sequence
  GFR-binding peptide
PTKMSPISMLYK

SEQ ID NO: 4881 - protein, 17 aa, Artificial Sequence
  GFR-binding peptide
  MOD_RES (3)..(4): Xaa is C or S
STXXAPVKTNAISMLYF

SEQ ID NO: 4882 - protein, 10 aa, Artificial Sequence
  GFR-binding peptide
KMNAISILYF

SEQ ID NO: 4883 - protein, 17 aa, Artificial Sequence
  GFR-binding peptide
  MOD_RES (3)..(4): Xaa is C or S
KAXXVPTKLSATSVLYY

SEQ ID NO: 4884 - protein, 19 aa, Artificial Sequence
  GFR-binding peptide
  MOD_RES (5)..(6): Xaa is C or S
SASPXXVSQDLSPINILYF

SEQ ID NO: 4885 - protein, 12 aa, Artificial Sequence
  GFR-binding peptide
PTRLEPISILYL

SEQ ID NO: 4886 - protein, 20 aa, Artificial Sequence
  GFR-binding peptide
  MOD_RES (6)..(7): Xaa is C or S
KASKAXXVPTKLSPISILYK

SEQ ID NO: 4887 - protein, 14 aa, Artificial Sequence
  GFR-binding peptide
  MOD_RES (1)..(1): Xaa is C or S
XVPTRLSPISILYK

SEQ ID NO: 4888 - protein, 15 aa, Artificial Sequence
  GFR-binding peptide
  MOD_RES (1)..(2): Xaa is C or S
XXAPTKLSPISVLYK

SEQ ID NO: 4889 - protein, 13 aa, Artificial Sequence
  GFR-binding peptide
VPARLEPISILYL

SEQ ID NO: 4890 - protein, 15 aa, Artificial Sequence
  GFR-binding peptide
  MOD_RES (1)..(2): Xaa is C or S
XXVPEKMEPISILYL

SEQ ID NO: 4891 - protein, 20 aa, Artificial Sequence
  GFR-binding peptide
  MOD_RES (6)..(7): Xaa is C or S
GIPEPXXVPEKMNAISILYF

SEQ ID NO: 4892 - protein, 19 aa, Artificial Sequence
  GFR-binding peptide
  MOD_RES (5)..(6): Xaa is C or S
APASXXVPARLEPISILYL

SEQ ID NO: 4893 - protein, 16 aa, Artificial Sequence
  GFR-binding peptide
  MOD_RES (2)..(3): Xaa is C or S
PXXAPTKLSPISVLYK

SEQ ID NO: 4894 - protein, 17 aa, Artificial Sequence
  GFR-binding peptide
  MOD_RES (3)..(4): Xaa is C or S
EPXXVPEKMSPISILYK

SEQ ID NO: 4895 - protein, 19 aa, Artificial Sequence
  GFR-binding peptide
  MOD_RES (5)..(6): Xaa is C or S
SAAPXXVPQALSPISILYK

SEQ ID NO: 4896 - protein, 18 aa, Artificial Sequence
  GFR-binding peptide
  MOD_RES (4)..(5): Xaa is C or S
PKAXXVPTELEPISMLYL

SEQ ID NO: 4897 - protein, 9 aa, Artificial Sequence
  GFR-binding peptide
MEPISILYL

SEQ ID NO: 4898 - protein, 16 aa, Artificial Sequence
  GFR-binding peptide
  MOD_RES (2)..(3): Xaa is C or S
TXXVPTRLSATSILYY

SEQ ID NO: 4899 - protein, 19 aa, Artificial Sequence
  GFR-binding peptide
  MOD_RES (5)..(6): Xaa is C or S
SAAPXXVPQALNAISILYF

SEQ ID NO: 4900 - protein, 13 aa, Artificial Sequence
  GFR-binding peptide
VPQDLSPISILYK

SEQ ID NO: 4901 - protein, 10 aa, Artificial Sequence
  GFR-binding peptide
QLSATSVLYY

SEQ ID NO: 4902 - protein, 14 aa, Artificial Sequence
  GFR-binding peptide
  MOD_RES (1)..(1): Xaa is C or S
XAPTQLSPISVLYK

SEQ ID NO: 4903 - protein, 10 aa, Artificial Sequence
  GFR-binding peptide
ALSPINILYF

SEQ ID NO: 4904 - protein, 13 aa, Artificial Sequence
  GFR-binding peptide
VPQALSPINILYF

SEQ ID NO: 4905 - protein, 13 aa, Artificial Sequence
  GFR-binding peptide
APTQLSPINVLYF

SEQ ID NO: 4906 - protein, 9 aa, Artificial Sequence
  GFR-binding peptide
LSATSILYY

SEQ ID NO: 4907 - protein, 17 aa, Artificial Sequence
  GFR-binding peptide
  MOD_RES (3)..(4): Xaa is C or S
KAXXVPTELSATSMLYY

SEQ ID NO: 4908 - protein, 15 aa, Artificial Sequence
  GFR-binding peptide
  MOD_RES (1)..(2): Xaa is C or S
XXVPARLSPINILYF

SEQ ID NO: 4909 - protein, 12 aa, Artificial Sequence
  GFR-binding peptide
PQDLNAISILYF

SEQ ID NO: 4910 - protein, 11 aa, Artificial Sequence
  GFR-binding peptide
EKMNAISILYF

SEQ ID NO: 4911 - protein, 19 aa, Artificial Sequence
  GFR-binding peptide
  MOD_RES (5)..(6): Xaa is C or S
IPKAXXVPTELNAISMLYF

SEQ ID NO: 4912 - protein, 18 aa, Artificial Sequence
  GFR-binding peptide
  MOD_RES (4)..(5): Xaa is C or S
PKPXXAPTKLEPISVLYL

SEQ ID NO: 4913 - protein, 12 aa, Artificial Sequence
  GFR-binding peptide
PVKTSATSMLYY

SEQ ID NO: 4914 - protein, 14 aa, Artificial Sequence
  GFR-binding peptide
  MOD_RES (1)..(1): Xaa is C or S
XVPTKLSATSVLYY

SEQ ID NO: 4915 - protein, 20 aa, Artificial Sequence
  GFR-binding peptide
  MOD_RES (6)..(7): Xaa is C or S
SIPKAXXVPTELSPISMLYK

SEQ ID NO: 4916 - protein, 20 aa, Artificial Sequence
  GFR-binding peptide
  MOD_RES (6)..(7): Xaa is C or S
SIPKAXXVPTELNAISMLYF

SEQ ID NO: 4917 - protein, 18 aa, Artificial Sequence
  GFR-binding peptide
  MOD_RES (4)..(5): Xaa is C or S
GKAXXVPTKLEPISVLYL

SEQ ID NO: 4918 - protein, 17 aa, Artificial Sequence
  GFR-binding peptide
  MOD_RES (3)..(4): Xaa is C or S
PTXXVPTRLEPISILYL

SEQ ID NO: 4919 - protein, 19 aa, Artificial Sequence
  GFR-binding peptide
  MOD_RES (5)..(6): Xaa is C or S
SASPXXVPQDLSPISILYK

SEQ ID NO: 4920 - protein, 20 aa, Artificial Sequence
  GFR-binding peptide
  MOD_RES (6)..(7): Xaa is C or S
KASKAXXVPTKLNAISILYF

SEQ ID NO: 4921 - protein, 9 aa, Artificial Sequence
  GFR-binding peptide
LNAISMLYF

SEQ ID NO: 4922 - protein, 9 aa, Artificial Sequence
  GFR-binding peptide
TEPISMLYL

SEQ ID NO: 4923 - protein, 10 aa, Artificial Sequence
  GFR-binding peptide
DLSATSILYY

SEQ ID NO: 4924 - protein, 16 aa, Artificial Sequence
  GFR-binding peptide
  MOD_RES (2)..(3): Xaa is C or S
AXXAPTKLNAISVLYF

SEQ ID NO: 4925 - protein, 16 aa, Artificial Sequence
  GFR-binding peptide
  MOD_RES (2)..(3): Xaa is C or S
AXXVPTKLNAISILYF

SEQ ID NO: 4926 - protein, 16 aa, Artificial Sequence
  GFR-binding peptide
  MOD_RES (3)..(3): Xaa is C or S
PTXAPTKLSATSVLYY

SEQ ID NO: 4927 - protein, 11 aa, Artificial Sequence
  GFR-binding peptide
TQLSATSVLYY

SEQ ID NO: 4928 - protein, 11 aa, Artificial Sequence
  GFR-binding peptide
TELEPISMLYL

SEQ ID NO: 4929 - protein, 13 aa, Artificial Sequence
  GFR-binding peptide
TPTKMSPISMLYK

SEQ ID NO: 4930 - protein, 15 aa, Artificial Sequence
  GFR-binding peptide
  MOD_RES (1)..(2): Xaa is C or S
XXVPTRLSPINILYF

SEQ ID NO: 4931 - protein, 15 aa, Artificial Sequence
  GFR-binding peptide
  MOD_RES (1)..(2): Xaa is C or S
XXVPTKLNAISVLYF

SEQ ID NO: 4932 - protein, 19 aa, Artificial Sequence
  GFR-binding peptide
  MOD_RES (5)..(6): Xaa is C or S
VGKAXXVPTKLSATSVLYY

SEQ ID NO: 4933 - protein, 10 aa, Artificial Sequence
  GFR-binding peptide
KTNAISMLYF

SEQ ID NO: 4934 - protein, 12 aa, Artificial Sequence
  GFR-binding peptide
PARLEPISILYL

SEQ ID NO: 4935 - protein, 11 aa, Artificial Sequence
  GFR-binding peptide
TQLSPISVLYK

SEQ ID NO: 4936 - protein, 13 aa, Artificial Sequence
  GFR-binding peptide
TPTKMSATSMLYY

SEQ ID NO: 4937 - protein, 17 aa, Artificial Sequence
  GFR-binding peptide
  MOD_RES (3)..(4): Xaa is C or S
ASXXVPARLNAISILYF

SEQ ID NO: 4938 - protein, 20 aa, Artificial Sequence
  GFR-binding peptide
  MOD_RES (6)..(7): Xaa is C or S
ASASPXXVPQDLSATSILYY

SEQ ID NO: 4939 - protein, 12 aa, Artificial Sequence
  GFR-binding peptide
PTQLSPINVLYF

SEQ ID NO: 4940 - protein, 15 aa, Artificial Sequence
  GFR-binding peptide
  MOD_RES (1)..(2): Xaa is C or S
XXVPTKLSATSVLYY

SEQ ID NO: 4941 - protein, 19 aa, Artificial Sequence
  GFR-binding peptide
  MOD_RES (5)..(6): Xaa is C or S
VPKPXXAPTQLSPISVLYK

SEQ ID NO: 4942 - protein, 11 aa, Artificial Sequence
  GFR-binding peptide
QDLEPISILYL

SEQ ID NO: 4943 - protein, 19 aa, Artificial Sequence
  GFR-binding peptide
  MOD_RES (5)..(6): Xaa is C or S
ASKAXXVPTKLNAISILYF

SEQ ID NO: 4944 - protein, 18 aa, Artificial Sequence
  GFR-binding peptide
  MOD_RES (4)..(5): Xaa is C or S
AAPXXVPQALNAISILYF

SEQ ID NO: 4945 - protein, 16 aa, Artificial Sequence
  GFR-binding peptide
  MOD_RES (3)..(3): Xaa is C or S
PTXAPTKLSPISVLYK

SEQ ID NO: 4946 - protein, 20 aa, Artificial Sequence
  GFR-binding peptide
  MOD_RES (6)..(7): Xaa is C or S
YVPKPXXAPTKLSPINVLYF

SEQ ID NO: 4947 - protein, 10 aa, Artificial Sequence
  GFR-binding peptide
ELSPINMLYF

SEQ ID NO: 4948 - protein, 15 aa, Artificial Sequence
  GFR-binding peptide
  MOD_RES (1)..(2): Xaa is C or S
XXVSQDLNAISILYF

SEQ ID NO: 4949 - protein, 19 aa, Artificial Sequence
  GFR-binding peptide
  MOD_RES (5)..(6): Xaa is C or S
VPKPXXAPTKLSPISVLYK

SEQ ID NO: 4950 - protein, 10 aa, Artificial Sequence
  GFR-binding peptide
KMSPISILYK

SEQ ID NO: 4951 - protein, 13 aa, Artificial Sequence
  GFR-binding peptide
VSQDLSPINILYF

SEQ ID NO: 4952 - protein, 13 aa, Artificial Sequence
  GFR-binding peptide
VPQDLSATSILYY

SEQ ID NO: 4953 - protein, 12 aa, Artificial Sequence
  GFR-binding peptide
PARLSATSILYY

SEQ ID NO: 4954 - protein, 17 aa, Artificial Sequence
  GFR-binding peptide
  MOD_RES (3)..(4): Xaa is C or S
GPXXTPTKMEPISMLYL

SEQ ID NO: 4955 - protein, 11 aa, Artificial Sequence
  GFR-binding peptide
QALNAISILYF

SEQ ID NO: 4956 - protein, 20 aa, Artificial Sequence
  GFR-binding peptide
  MOD_RES (6)..(7): Xaa is C or S
ASASPXXVSQDLNAISILYF

SEQ ID NO: 4957 - protein, 19 aa, Artificial Sequence
  GFR-binding peptide
  MOD_RES (5)..(6): Xaa is C or S
VPSTXXAPVKTNAISMLYF

SEQ ID NO: 4958 - protein, 18 aa, Artificial Sequence
  GFR-binding peptide
  MOD_RES (4)..(5): Xaa is C or S
AGPXXTPTKMSATSMLYY

SEQ ID NO: 4959 - protein, 10 aa, Artificial Sequence
  GFR-binding peptide
QLSPISVLYK

SEQ ID NO: 4960 - protein, 19 aa, Artificial Sequence
  GFR-binding peptide
  MOD_RES (5)..(6): Xaa is C or S
VPSTXXAPVKTSPISMLYK

SEQ ID NO: 4961 - protein, 11 aa, Artificial Sequence
  GFR-binding peptide
VKTNAISMLYF

SEQ ID NO: 4962 - protein, 15 aa, Artificial Sequence
  GFR-binding peptide
  MOD_RES (1)..(2): Xaa is C or S
XXVPQALEPISILYL

SEQ ID NO: 4963 - protein, 18 aa, Artificial Sequence
  GFR-binding peptide
  MOD_RES (4)..(5): Xaa is C or S
ASPXXVPQDLNAISILYF

SEQ ID NO: 4964 - protein, 20 aa, Artificial Sequence
  GFR-binding peptide
  MOD_RES (6)..(7): Xaa is C or S
ASASPXXVSQDLSPISILYK

SEQ ID NO: 4965 - protein, 15 aa, Artificial Sequence
  GFR-binding peptide
  MOD_RES (1)..(2): Xaa is C or S
XXVPTELSATSMLYY

SEQ ID NO: 4966 - protein, 13 aa, Artificial Sequence
  GFR-binding peptide
VSQDLSPISILYK

SEQ ID NO: 4967 - protein, 16 aa, Artificial Sequence
  GFR-binding peptide
  MOD_RES (2)..(3): Xaa is C or S
PXXVPQDLNAISILYF

SEQ ID NO: 4968 - protein, 14 aa, Artificial Sequence
  GFR-binding peptide
  MOD_RES (1)..(1): Xaa is C or S
XAPTQLSATSVLYY

SEQ ID NO: 4969 - protein, 16 aa, Artificial Sequence
  GFR-binding peptide
  MOD_RES (2)..(3): Xaa is C or S
SXXVPARLSATSILYY

SEQ ID NO: 4970 - protein, 9 aa, Artificial Sequence
  GFR-binding peptide
LSPISILYK

SEQ ID NO: 4971 - protein, 18 aa, Artificial Sequence
  GFR-binding peptide
  MOD_RES (4)..(5): Xaa is C or S
PPTXXVPTRLNAISILYF

SEQ ID NO: 4972 - protein, 16 aa, Artificial Sequence
  GFR-binding peptide
  MOD_RES (2)..(3): Xaa is C or S
PXXTPTKMNAISMLYF

SEQ ID NO: 4973 - protein, 19 aa, Artificial Sequence
  GFR-binding peptide
  MOD_RES (5)..(6): Xaa is C or S
IPEPXXVPEKMNAISILYF

SEQ ID NO: 4974 - protein, 16 aa, Artificial Sequence
  GFR-binding peptide
  MOD_RES (2)..(3): Xaa is C or S
PXXAPTQLSPISVLYK

SEQ ID NO: 4975 - protein, 18 aa, Artificial Sequence
  GFR-binding peptide
  MOD_RES (4)..(5): Xaa is C or S
AAPXXVPQALEPISILYL

SEQ ID NO: 4976 - protein, 20 aa, Artificial Sequence
  GFR-binding peptide
  MOD_RES (6)..(7): Xaa is C or S
HVPKPXXAPTKLEPISVLYL

SEQ ID NO: 4977 - protein, 15 aa, Artificial Sequence
  GFR-binding peptide
  MOD_RES (1)..(2): Xaa is C or S
XXVPTKLSPISILYK

SEQ ID NO: 4978 - protein, 18 aa, Artificial Sequence
  GFR-binding peptide
  MOD_RES (4)..(5): Xaa is C or S
PEPXXVPEKMSPISILYK

SEQ ID NO: 4979 - protein, 14 aa, Artificial Sequence
  GFR-binding peptide
  MOD_RES (1)..(1): Xaa is C or S
XVPTKLSATSILYY

SEQ ID NO: 4980 - protein, 17 aa, Artificial Sequence
  GFR-binding peptide
  MOD_RES (3)..(4): Xaa is C or S
SPXXVPQDLEPISILYL

SEQ ID NO: 4981 - protein, 20 aa, Artificial Sequence
  GFR-binding peptide
  MOD_RES (6)..(7): Xaa is C or S
AAPASXXVPARLSPINILYF

SEQ ID NO: 4982 - protein, 13 aa, Artificial Sequence
  GFR-binding peptide
VPTKLSPINVLYF

SEQ ID NO: 4983 - protein, 13 aa, Artificial Sequence
  GFR-binding peptide
VPEKMSPINILYF

SEQ ID NO: 4984 - protein, 10 aa, Artificial Sequence
  GFR-binding peptide
KLSPINVLYF

SEQ ID NO: 4985 - protein, 10 aa, Artificial Sequence
  GFR-binding peptide
KMSATSILYY

SEQ ID NO: 4986 - protein, 12 aa, Artificial Sequence
  GFR-binding peptide
PVKTSPISMLYK

SEQ ID NO: 4987 - protein, 14 aa, Artificial Sequence
  GFR-binding peptide
  MOD_RES (1)..(1): Xaa is C or S
XVPEKMEPISILYL

SEQ ID NO: 4988 - protein, 17 aa, Artificial Sequence
  GFR-binding peptide
  MOD_RES (4)..(4): Xaa is C or S
KPTXAPTKLSPINVLYF

SEQ ID NO: 4989 - protein, 14 aa, Artificial Sequence
  GFR-binding peptide
  MOD_RES (1)..(1): Xaa is C or S
XVPTELEPISMLYL

SEQ ID NO: 4990 - protein, 16 aa, Artificial Sequence
  GFR-binding peptide
  MOD_RES (2)..(3): Xaa is C or S
PXXVPQALNAISILYF

SEQ ID NO: 4991 - protein, 16 aa, Artificial Sequence
  GFR-binding peptide
  MOD_RES (2)..(3): Xaa is C or S
PXXVSQDLEPISILYL

SEQ ID NO: 4992 - protein, 17 aa, Artificial Sequence
  GFR-binding peptide
  MOD_RES (3)..(4): Xaa is C or S
EPXXVPEKMSATSILYY

SEQ ID NO: 4993 - protein, 14 aa, Artificial Sequence
  GFR-binding peptide
  MOD_RES (1)..(1): Xaa is C or S
XAPTKLSPISVLYK

SEQ ID NO: 4994 - protein, 14 aa, Artificial Sequence
  GFR-binding peptide
  MOD_RES (1)..(1): Xaa is C or S
XVPEKMNAISILYF

SEQ ID NO: 4995 - protein, 19 aa, Artificial Sequence
  GFR-binding peptide
  MOD_RES (5)..(6): Xaa is C or S
TPPTXXVPTRLNAISILYF

SEQ ID NO: 4996 - protein, 16 aa, Artificial Sequence
  GFR-binding peptide
  MOD_RES (2)..(3): Xaa is C or S
PXXVPQALEPISILYL

SEQ ID NO: 4997 - protein, 12 aa, Artificial Sequence
  GFR-binding peptide
PTKLSPINILYF

SEQ ID NO: 4998 - protein, 12 aa, Artificial Sequence
  GFR-binding peptide
PTELSPINMLYF

SEQ ID NO: 4999 - protein, 17 aa, Artificial Sequence
  GFR-binding peptide
  MOD_RES (3)..(4): Xaa is C or S
GPXXTPTKMNAISMLYF

SEQ ID NO: 5000 - protein, 17 aa, Artificial Sequence
  GFR-binding peptide
  MOD_RES (3)..(4): Xaa is C or S
KAXXVPTKLSATSILYY

SEQ ID NO: 5001 - protein, 13 aa, Artificial Sequence
  GFR-binding peptide
APVKTSPINMLYF

SEQ ID NO: 5002 - protein, 11 aa, Artificial Sequence
  GFR-binding peptide
EKMSPISILYK

SEQ ID NO: 5003 - protein, 18 aa, Artificial Sequence
  GFR-binding peptide
  MOD_RES (4)..(5): Xaa is C or S
ASPXXVSQDLSATSILYY

SEQ ID NO: 5004 - protein, 14 aa, Artificial Sequence
  GFR-binding peptide
  MOD_RES (1)..(1): Xaa is C or S
XVPTKLEPISVLYL

SEQ ID NO: 5005 - protein, 20 aa, Artificial Sequence
  GFR-binding peptide
  MOD_RES (6)..(7): Xaa is C or S
STPPTXXVPTRLNAISILYF

SEQ ID NO: 5006 - protein, 10 aa, Artificial Sequence
  GFR-binding peptide
ALSPISILYK

SEQ ID NO: 5007 - protein, 18 aa, Artificial Sequence
  GFR-binding peptide
  MOD_RES (4)..(5): Xaa is C or S
PKAXXVPTELSATSMLYY

SEQ ID NO: 5008 - protein, 16 aa, Artificial Sequence
  GFR-binding peptide
  MOD_RES (2)..(3): Xaa is C or S
AXXAPTKLEPISVLYL

SEQ ID NO: 5009 - protein, 13 aa, Artificial Sequence
  GFR-binding peptide
VPTRLNAISILYF

SEQ ID NO: 5010 - protein, 17 aa, Artificial Sequence
  GFR-binding peptide
  MOD_RES (3)..(4): Xaa is C or S
KAXXAPTKLSPISVLYK

SEQ ID NO: 5011 - protein, 13 aa, Artificial Sequence
  GFR-binding peptide
VPARLSATSILYY

SEQ ID NO: 5012 - protein, 12 aa, Artificial Sequence
  GFR-binding peptide
PQALSATSILYY

SEQ ID NO: 5013 - protein, 11 aa, Artificial Sequence
  GFR-binding peptide
TKLSATSILYY

SEQ ID NO: 5014 - protein, 19 aa, Artificial Sequence
  GFR-binding peptide
  MOD_RES (5)..(6): Xaa is C or S
IPEPXXVPEKMEPISILYL

SEQ ID NO: 5015 - protein, 12 aa, Artificial Sequence
  GFR-binding peptide
PQDLSPISILYK

SEQ ID NO: 5016 - protein, 13 aa, Artificial Sequence
  GFR-binding peptide
VPQALSPISILYK

SEQ ID NO: 5017 - protein, 15 aa, Artificial Sequence
  GFR-binding peptide
  MOD_RES (1)..(2): Xaa is C or S
XXAPTQLSPISVLYK

SEQ ID NO: 5018 - protein, 11 aa, Artificial Sequence
  GFR-binding peptide
TELSATSMLYY

SEQ ID NO: 5019 - protein, 15 aa, Artificial Sequence
  GFR-binding peptide
  MOD_RES (1)..(2): Xaa is C or S
XXVPTELNAISMLYF

SEQ ID NO: 5020 - protein, 15 aa, Artificial Sequence
  GFR-binding peptide
  MOD_RES (1)..(2): Xaa is C or S
XXVSQDLEPISILYL

SEQ ID NO: 5021 - protein, 11 aa, Artificial Sequence
  GFR-binding peptide
VKTEPISMLYL

SEQ ID NO: 5022 - protein, 18 aa, Artificial Sequence
  GFR-binding peptide
  MOD_RES (4)..(5): Xaa is C or S
PASXXVPARLEPISILYL

SEQ ID NO: 5023 - protein, 19 aa, Artificial Sequence
  GFR-binding peptide
  MOD_RES (6)..(6): Xaa is C or S
VTKPTXAPTKLSPISVLYK

SEQ ID NO: 5024 - protein, 16 aa, Artificial Sequence
  GFR-binding peptide
  MOD_RES (2)..(3): Xaa is C or S
TXXVPTRLSPISILYK

SEQ ID NO: 5025 - protein, 15 aa, Artificial Sequence
  GFR-binding peptide
  MOD_RES (1)..(2): Xaa is C or S
XXVPEKMSATSILYY

SEQ ID NO: 5026 - protein, 18 aa, Artificial Sequence
  GFR-binding peptide
  MOD_RES (4)..(5): Xaa is C or S
PKAXXAPTKLSPISVLYK

SEQ ID NO: 5027 - protein, 11 aa, Artificial Sequence
  GFR-binding peptide
EKMSATSILYY

SEQ ID NO: 5028 - protein, 13 aa, Artificial Sequence
  GFR-binding peptide
VPTELSPINMLYF

SEQ ID NO: 5029 - protein, 19 aa, Artificial Sequence
  GFR-binding peptide
  MOD_RES (5)..(6): Xaa is C or S
VPKPXXAPTKLSATSVLYY

SEQ ID NO: 5030 - protein, 19 aa, Artificial Sequence
  GFR-binding peptide
  MOD_RES (5)..(6): Xaa is C or S
TPPTXXVPTRLEPISILYL

SEQ ID NO: 5031 - protein, 20 aa, Artificial Sequence
  GFR-binding peptide
  MOD_RES (6)..(7): Xaa is C or S
KIPKAXXVPTELSPISMLYK

SEQ ID NO: 5032 - protein, 11 aa, Artificial Sequence
  GFR-binding peptide
TRLSPINILYF

SEQ ID NO: 5033 - protein, 18 aa, Artificial Sequence
  GFR-binding peptide
  MOD_RES (4)..(5): Xaa is C or S
SKAXXVPTKLNAISILYF

SEQ ID NO: 5034 - protein, 18 aa, Artificial Sequence
  GFR-binding peptide
  MOD_RES (4)..(5): Xaa is C or S
AGPXXTPTKMSPISMLYK

SEQ ID NO: 5035 - protein, 10 aa, Artificial Sequence
  GFR-binding peptide
KMNAISMLYF

SEQ ID NO: 5036 - protein, 20 aa, Artificial Sequence
  GFR-binding peptide
  MOD_RES (6)..(7): Xaa is C or S
ASASPXXVSQDLSATSILYY

SEQ ID NO: 5037 - protein, 14 aa, Artificial Sequence
  GFR-binding peptide
  MOD_RES (1)..(1): Xaa is C or S
XAPVKTEPISMLYL

SEQ ID NO: 5038 - protein, 12 aa, Artificial Sequence
  GFR-binding peptide
SQDLSPISILYK

SEQ ID NO: 5039 - protein, 20 aa, Artificial Sequence
  GFR-binding peptide
  MOD_RES (6)..(7): Xaa is C or S
KIPKAXXVPTELSATSMLYY

SEQ ID NO: 5040 - protein, 18 aa, Artificial Sequence
  GFR-binding peptide
  MOD_RES (4)..(5): Xaa is C or S
PPTXXVPTRLEPISILYL

SEQ ID NO: 5041 - protein, 12 aa, Artificial Sequence
  GFR-binding peptide
PQDLSATSILYY

SEQ ID NO: 5042 - protein, 16 aa, Artificial Sequence
  GFR-binding peptide
  MOD_RES (2)..(3): Xaa is C or S
PXXVSQDLNAISILYF

SEQ ID NO: 5043 - protein, 15 aa, Artificial Sequence
  GFR-binding peptide
  MOD_RES (1)..(2): Xaa is C or S
XXAPVKTEPISMLYL

SEQ ID NO: 5044 - protein, 14 aa, Artificial Sequence
  GFR-binding peptide
  MOD_RES (1)..(1): Xaa is C or S
XVPTELNAISMLYF

SEQ ID NO: 5045 - protein, 16 aa, Artificial Sequence
  GFR-binding peptide
  MOD_RES (2)..(3): Xaa is C or S
PXXVPEKMSATSILYY

SEQ ID NO: 5046 - protein, 12 aa, Artificial Sequence
  GFR-binding peptide
PTKLSPINVLYF

SEQ ID NO: 5047 - protein, 20 aa, Artificial Sequence
  GFR-binding peptide
  MOD_RES (6)..(7): Xaa is C or S
ASASPXXVPQDLNAISILYF

SEQ ID NO: 5048 - protein, 15 aa, Artificial Sequence
  GFR-binding peptide
  MOD_RES (1)..(2): Xaa is C or S
XXVPTKLSATSILYY

SEQ ID NO: 5049 - protein, 14 aa, Artificial Sequence
  GFR-binding peptide
  MOD_RES (1)..(1): Xaa is C or S
XVPTKLNAISVLYF

SEQ ID NO: 5050 - protein, 10 aa, Artificial Sequence
  GFR-binding peptide
DLSPISILYK

SEQ ID NO: 5051 - protein, 19 aa, Artificial Sequence
  GFR-binding peptide
  MOD_RES (5)..(6): Xaa is C or S
IPKAXXVPTELEPISMLYL

SEQ ID NO: 5052 - protein, 15 aa, Artificial Sequence
  GFR-binding peptide
  MOD_RES (1)..(2): Xaa is C or S
XXAPTQLSATSVLYY

SEQ ID NO: 5053 - protein, 13 aa, Artificial Sequence
  GFR-binding peptide
VPTRLEPISILYL

SEQ ID NO: 5054 - protein, 19 aa, Artificial Sequence
  GFR-binding peptide
  MOD_RES (6)..(6): Xaa is C or S
VTKPTXAPTKLSATSVLYY

SEQ ID NO: 5055 - protein, 10 aa, Artificial Sequence
  GFR-binding peptide
KLSPINILYF

SEQ ID NO: 5056 - protein, 17 aa, Artificial Sequence
  GFR-binding peptide
  MOD_RES (3)..(4): Xaa is C or S
PTXXVPTRLNAISILYF

SEQ ID NO: 5057 - protein, 16 aa, Artificial Sequence
  GFR-binding peptide
  MOD_RES (2)..(3): Xaa is C or S
PXXTPTKMEPISMLYL

SEQ ID NO: 5058 - protein, 11 aa, Artificial Sequence
  GFR-binding peptide
TKLSPISILYK

SEQ ID NO: 5059 - protein, 17 aa, Artificial Sequence
  GFR-binding peptide
  MOD_RES (3)..(4): Xaa is C or S
KAXXVPTKLSPISILYK

SEQ ID NO: 5060 - protein, 20 aa, Artificial Sequence
  GFR-binding peptide
  MOD_RES (6)..(7): Xaa is C or S
KASKAXXVPTKLSATSILYY

SEQ ID NO: 5061 - protein, 10 aa, Artificial Sequence
  GFR-binding peptide
KMEPISMLYL

SEQ ID NO: 5062 - protein, 12 aa, Artificial Sequence
  GFR-binding peptide
PTKMNAISMLYF

SEQ ID NO: 5063 - protein, 14 aa, Artificial Sequence
  GFR-binding peptide
  MOD_RES (1)..(1): Xaa is C or S
XVPARLSPINILYF

SEQ ID NO: 5064 - protein, 18 aa, Artificial Sequence
  GFR-binding peptide
  MOD_RES (4)..(5): Xaa is C or S
PEPXXVPEKMSATSILYY

SEQ ID NO: 5065 - protein, 17 aa, Artificial Sequence
  GFR-binding peptide
  MOD_RES (3)..(4): Xaa is C or S
SPXXVSQDLNAISILYF

SEQ ID NO: 5066 - protein, 12 aa, Artificial Sequence
  GFR-binding peptide
PEKMSPINILYF

SEQ ID NO: 5067 - protein, 18 aa, Artificial Sequence
  GFR-binding peptide
  MOD_RES (4)..(5): Xaa is C or S
PKAXXVPTELSPISMLYK

SEQ ID NO: 5068 - protein, 10 aa, Artificial Sequence
  GFR-binding peptide
ALSATSILYY

SEQ ID NO: 5069 - protein, 10 aa, Artificial Sequence
  GFR-binding peptide
ELSPISMLYK

SEQ ID NO: 5070 - protein, 18 aa, Artificial Sequence
  GFR-binding peptide
  MOD_RES (4)..(5): Xaa is C or S
ASPXXVSQDLSPISILYK

SEQ ID NO: 5071 - protein, 19 aa, Artificial Sequence
  GFR-binding peptide
  MOD_RES (5)..(6): Xaa is C or S
SASPXXVSQDLSATSILYY

SEQ ID NO: 5072 - protein, 17 aa, Artificial Sequence
  GFR-binding peptide
  MOD_RES (3)..(4): Xaa is C or S
STXXAPVKTEPISMLYL

SEQ ID NO: 5073 - protein, 9 aa, Artificial Sequence
  GFR-binding peptide
TNAISMLYF

SEQ ID NO: 5074 - protein, 19 aa, Artificial Sequence
  GFR-binding peptide
  MOD_RES (5)..(6): Xaa is C or S
IPEPXXVPEKMSATSILYY

SEQ ID NO: 5075 - protein, 18 aa, Artificial Sequence
  GFR-binding peptide
  MOD_RES (4)..(5): Xaa is C or S
PPTXXVPTRLSATSILYY

SEQ ID NO: 5076 - protein, 15 aa, Artificial Sequence
  GFR-binding peptide
  MOD_RES (1)..(2): Xaa is C or S
XXAPTKLEPISVLYL

SEQ ID NO: 5077 - protein, 17 aa, Artificial Sequence
  GFR-binding peptide
  MOD_RES (3)..(4): Xaa is C or S
EPXXVPEKMEPISILYL

SEQ ID NO: 5078 - protein, 15 aa, Artificial Sequence
  GFR-binding peptide
  MOD_RES (1)..(2): Xaa is C or S
XXAPVKTNAISMLYF

SEQ ID NO: 5079 - protein, 10 aa, Artificial Sequence
  GFR-binding peptide
RLSPINILYF

SEQ ID NO: 5080 - protein, 19 aa, Artificial Sequence
  GFR-binding peptide
  MOD_RES (5)..(6): Xaa is C or S
VPKPXXAPTKLEPISVLYL

SEQ ID NO: 5081 - protein, 17 aa, Artificial Sequence
  GFR-binding peptide
  MOD_RES (3)..(4): Xaa is C or S
ASXXVPARLEPISILYL

SEQ ID NO: 5082 - protein, 15 aa, Artificial Sequence
  GFR-binding peptide
  MOD_RES (1)..(2): Xaa is C or S
XXAPVKTSPISMLYK

SEQ ID NO: 5083 - protein, 13 aa, Artificial Sequence
  GFR-binding peptide
VPTKLSPINILYF

SEQ ID NO: 5084 - protein, 19 aa, Artificial Sequence
  GFR-binding peptide
  MOD_RES (6)..(6): Xaa is C or S
VTKPTXAPTKLSPINVLYF

SEQ ID NO: 5085 - protein, 12 aa, Artificial Sequence
  GFR-binding peptide
PARLNAISILYF

SEQ ID NO: 5086 - protein, 19 aa, Artificial Sequence
  GFR-binding peptide
  MOD_RES (5)..(6): Xaa is C or S
VGKAXXVPTKLEPISVLYL

SEQ ID NO: 5087 - protein, 13 aa, Artificial Sequence
  GFR-binding peptide
VSQDLSATSILYY

SEQ ID NO: 5088 - protein, 10 aa, Artificial Sequence
  GFR-binding peptide
ELNAISMLYF

SEQ ID NO: 5089 - protein, 14 aa, Artificial Sequence
  GFR-binding peptide
  MOD_RES (1)..(1): Xaa is C or S
XVPTKLSPINVLYF

SEQ ID NO: 5090 - protein, 10 aa, Artificial Sequence
  GFR-binding peptide
KTSATSMLYY

SEQ ID NO: 5091 - protein, 16 aa, Artificial Sequence
  GFR-binding peptide
  MOD_RES (2)..(3): Xaa is C or S
PXXVPQDLEPISILYL

SEQ ID NO: 5092 - protein, 10 aa, Artificial Sequence
  GFR-binding peptide
KMSPISMLYK

SEQ ID NO: 5093 - protein, 14 aa, Artificial Sequence
  GFR-binding peptide
  MOD_RES (1)..(1): Xaa is C or S
XVPTRLEPISILYL

SEQ ID NO: 5094 - protein, 11 aa, Artificial Sequence
  GFR-binding peptide
VKTSATSMLYY

SEQ ID NO: 5095 - protein, 11 aa, Artificial Sequence
  GFR-binding peptide
TQLSPINVLYF

SEQ ID NO: 5096 - protein, 10 aa, Artificial Sequence
  GFR-binding peptide
KMEPISILYL

SEQ ID NO: 5097 - protein, 11 aa, Artificial Sequence
  GFR-binding peptide
QALEPISILYL

SEQ ID NO: 5098 - protein, 18 aa, Artificial Sequence
  GFR-binding peptide
  MOD_RES (4)..(5): Xaa is C or S
PKPXXAPTQLSPINVLYF

SEQ ID NO: 5099 - protein, 15 aa, Artificial Sequence
  GFR-binding peptide
  MOD_RES (1)..(2): Xaa is C or S
XXVPEKMNAISILYF

SEQ ID NO: 5100 - protein, 10 aa, Artificial Sequence
  GFR-binding peptide
RLEPISILYL

SEQ ID NO: 5101 - protein, 13 aa, Artificial Sequence
  GFR-binding peptide
VPARLNAISILYF

SEQ ID NO: 5102 - protein, 9 aa, Artificial Sequence
  GFR-binding peptide
MSATSILYY

SEQ ID NO: 5103 - protein, 20 aa, Artificial Sequence
  GFR-binding peptide
  MOD_RES (6)..(7): Xaa is C or S
SIPKAXXVPTELEPISMLYL

SEQ ID NO: 5104 - protein, 20 aa, Artificial Sequence
  GFR-binding peptide
  MOD_RES (7)..(7): Xaa is C or S
HVTKPTXAPTKLEPISVLYL

SEQ ID NO: 5105 - protein, 15 aa, Artificial Sequence
  GFR-binding peptide
  MOD_RES (1)..(2): Xaa is C or S
XXVPARLSPISILYK

SEQ ID NO: 5106 - protein, 20 aa, Artificial Sequence
  GFR-binding peptide
  MOD_RES (6)..(7): Xaa is C or S
HVPKPXXAPTKLSPINVLYF

SEQ ID NO: 5107 - protein, 19 aa, Artificial Sequence
  GFR-binding peptide
  MOD_RES (5)..(6): Xaa is C or S
VPKPXXAPTQLSATSVLYY

SEQ ID NO: 5108 - protein, 17 aa, Artificial Sequence
  GFR-binding peptide
  MOD_RES (3)..(4): Xaa is C or S
GPXXTPTKMSPISMLYK

SEQ ID NO: 5109 - protein, 14 aa, Artificial Sequence
  GFR-binding peptide
  MOD_RES (1)..(1): Xaa is C or S
XAPVKTSPISMLYK

SEQ ID NO: 5110 - protein, 15 aa, Artificial Sequence
  GFR-binding peptide
  MOD_RES (2)..(2): Xaa is C or S
TXAPTKLEPISVLYL

SEQ ID NO: 5111 - protein, 11 aa, Artificial Sequence
  GFR-binding peptide
QALSPINILYF

SEQ ID NO: 5112 - protein, 19 aa, Artificial Sequence
  GFR-binding peptide
  MOD_RES (5)..(6): Xaa is C or S
TPPTXXVPTRLSPISILYK

SEQ ID NO: 5113 - protein, 17 aa, Artificial Sequence
  GFR-binding peptide
  MOD_RES (3)..(4): Xaa is C or S
KAXXVPTELSPINMLYF

SEQ ID NO: 5114 - protein, 17 aa, Artificial Sequence
  GFR-binding peptide
  MOD_RES (3)..(4): Xaa is C or S
SPXXVPQDLNAISILYF

SEQ ID NO: 5115 - protein, 15 aa, Artificial Sequence
  GFR-binding peptide
  MOD_RES (1)..(2): Xaa is C or S
XXVPTKLSPINILYF

SEQ ID NO: 5116 - protein, 20 aa, Artificial Sequence
  GFR-binding peptide
  MOD_RES (6)..(7): Xaa is C or S
ASASPXXVSQDLSPINILYF

SEQ ID NO: 5117 - protein, 16 aa, Artificial Sequence
  GFR-binding peptide
  MOD_RES (2)..(3): Xaa is C or S
PXXVPQDLSPINILYF

SEQ ID NO: 5118 - protein, 18 aa, Artificial Sequence
  GFR-binding peptide
  MOD_RES (4)..(5): Xaa is C or S
PASXXVPARLNAISILYF

SEQ ID NO: 5119 - protein, 19 aa, Artificial Sequence
  GFR-binding peptide
  MOD_RES (5)..(6): Xaa is C or S
APASXXVPARLSATSILYY

SEQ ID NO: 5120 - protein, 11 aa, Artificial Sequence
  GFR-binding peptide
TQLEPISVLYL

SEQ ID NO: 5121 - protein, 9 aa, Artificial Sequence
  GFR-binding peptide
LSATSMLYY

SEQ ID NO: 5122 - protein, 14 aa, Artificial Sequence
  GFR-binding peptide
  MOD_RES (1)..(1): Xaa is C or S
XAPVKTNAISMLYF

SEQ ID NO: 5123 - protein, 18 aa, Artificial Sequence
  GFR-binding peptide
  MOD_RES (4)..(5): Xaa is C or S
PKAXXVPTELNAISMLYF

SEQ ID NO: 5124 - protein, 13 aa, Artificial Sequence
  GFR-binding peptide
VPQALSATSILYY

SEQ ID NO: 5125 - protein, 13 aa, Artificial Sequence
  GFR-binding peptide
VPTKLEPISVLYL

SEQ ID NO: 5126 - protein, 18 aa, Artificial Sequence
  GFR-binding peptide
  MOD_RES (4)..(5): Xaa is C or S
AGPXXTPTKMEPISMLYL

SEQ ID NO: 5127 - protein, 13 aa, Artificial Sequence
  GFR-binding peptide
VPEKMSPISILYK

SEQ ID NO: 5128 - protein, 13 aa, Artificial Sequence
  GFR-binding peptide
VPARLSPISILYK

SEQ ID NO: 5129 - protein, 15 aa, Artificial Sequence
  GFR-binding peptide
  MOD_RES (1)..(2): Xaa is C or S
XXVPEKMSPISILYK

SEQ ID NO: 5130 - protein, 15 aa, Artificial Sequence
  GFR-binding peptide
  MOD_RES (1)..(2): Xaa is C or S
XXVPTKLEPISVLYL

SEQ ID NO: 5131 - protein, 17 aa, Artificial Sequence
  GFR-binding peptide
  MOD_RES (3)..(4): Xaa is C or S
APXXVPQALSPISILYK

SEQ ID NO: 5132 - protein, 12 aa, Artificial Sequence
  GFR-binding peptide
PTRLSPISILYK

SEQ ID NO: 5133 - protein, 13 aa, Artificial Sequence
  GFR-binding peptide
VPEKMNAISILYF

SEQ ID NO: 5134 - protein, 18 aa, Artificial Sequence
  GFR-binding peptide
  MOD_RES (4)..(5): Xaa is C or S
GKAXXVPTKLNAISVLYF

SEQ ID NO: 5135 - protein, 10 aa, Artificial Sequence
  GFR-binding peptide
KLSATSILYY

SEQ ID NO: 5136 - protein, 20 aa, Artificial Sequence
  GFR-binding peptide
  MOD_RES (6)..(7): Xaa is C or S
STPPTXXVPTRLSATSILYY

SEQ ID NO: 5137 - protein, 15 aa, Artificial Sequence
  GFR-binding peptide
  MOD_RES (1)..(2): Xaa is C or S
XXVPARLNAISILYF

SEQ ID NO: 5138 - protein, 15 aa, Artificial Sequence
  GFR-binding peptide
  MOD_RES (1)..(2): Xaa is C or S
XXVPQALSATSILYY

SEQ ID NO: 5139 - protein, 17 aa, Artificial Sequence
  GFR-binding peptide
  MOD_RES (3)..(4): Xaa is C or S
ASXXVPARLSPINILYF

SEQ ID NO: 5140 - protein, 12 aa, Artificial Sequence
  GFR-binding peptide
PTRLNAISILYF

SEQ ID NO: 5141 - protein, 14 aa, Artificial Sequence
  GFR-binding peptide
  MOD_RES (1)..(1): Xaa is C or S
XAPTKLSPINVLYF

SEQ ID NO: 5142 - protein, 17 aa, Artificial Sequence
  GFR-binding peptide
  MOD_RES (3)..(4): Xaa is C or S
APXXVPQALNAISILYF

SEQ ID NO: 5143 - protein, 20 aa, Artificial Sequence
  GFR-binding peptide
  MOD_RES (6)..(7): Xaa is C or S
AVPKAXXAPTKLSPINVLYF

SEQ ID NO: 5144 - protein, 19 aa, Artificial Sequence
  GFR-binding peptide
  MOD_RES (5)..(6): Xaa is C or S
VPKPXXAPTKLSPINVLYF

SEQ ID NO: 5145 - protein, 12 aa, Artificial Sequence
  GFR-binding peptide
SQDLSATSILYY

SEQ ID NO: 5146 - protein, 20 aa, Artificial Sequence
  GFR-binding peptide
  MOD_RES (6)..(7): Xaa is C or S
GIPEPXXVPEKMSPINILYF

SEQ ID NO: 5147 - protein, 18 aa, Artificial Sequence
  GFR-binding peptide
  MOD_RES (4)..(5): Xaa is C or S
ASPXXVPQDLSPISILYK

SEQ ID NO: 5148 - protein, 13 aa, Artificial Sequence
  GFR-binding peptide
APTKLSPINVLYF

SEQ ID NO: 5149 - protein, 19 aa, Artificial Sequence
  GFR-binding peptide
  MOD_RES (5)..(6): Xaa is C or S
VPSTXXAPVKTEPISMLYL

SEQ ID NO: 5150 - protein, 20 aa, Artificial Sequence
  GFR-binding peptide
  MOD_RES (6)..(7): Xaa is C or S
RVPSTXXAPVKTSPISMLYK

SEQ ID NO: 5151 - protein, 16 aa, Artificial Sequence
  GFR-binding peptide
  MOD_RES (2)..(3): Xaa is C or S
SXXVPARLSPINILYF

SEQ ID NO: 5152 - protein, 19 aa, Artificial Sequence
  GFR-binding peptide
  MOD_RES (5)..(6): Xaa is C or S
SAAPXXVPQALSATSILYY

SEQ ID NO: 5153 - protein, 17 aa, Artificial Sequence
  GFR-binding peptide
  MOD_RES (3)..(4): Xaa is C or S
KAXXAPTKLNAISVLYF

SEQ ID NO: 5154 - protein, 17 aa, Artificial Sequence
  GFR-binding peptide
  MOD_RES (3)..(4): Xaa is C or S
SPXXVPQDLSPISILYK

SEQ ID NO: 5155 - protein, 12 aa, Artificial Sequence
  GFR-binding peptide
PTKMSATSMLYY

SEQ ID NO: 5156 - protein, 19 aa, Artificial Sequence
  GFR-binding peptide
  MOD_RES (5)..(6): Xaa is C or S
SASPXXVPQDLSATSILYY

SEQ ID NO: 5157 - protein, 16 aa, Artificial Sequence
  GFR-binding peptide
  MOD_RES (2)..(3): Xaa is C or S
PXXVPQALSPISILYK

SEQ ID NO: 5158 - protein, 12 aa, Artificial Sequence
  GFR-binding peptide
PEKMSPISILYK

SEQ ID NO: 5159 - protein, 16 aa, Artificial Sequence
  GFR-binding peptide
  MOD_RES (2)..(3): Xaa is C or S
PXXAPTQLEPISVLYL

SEQ ID NO: 5160 - protein, 14 aa, Artificial Sequence
  GFR-binding peptide
  MOD_RES (1)..(1): Xaa is C or S
XVPEKMSPISILYK

SEQ ID NO: 5161 - protein, 14 aa, Artificial Sequence
  GFR-binding peptide
  MOD_RES (1)..(1): Xaa is C or S
XVPTRLSPINILYF

SEQ ID NO: 5162 - protein, 16 aa, Artificial Sequence
  GFR-binding peptide
  MOD_RES (2)..(3): Xaa is C or S
PXXAPTKLSATSVLYY

SEQ ID NO: 5163 - protein, 20 aa, Artificial Sequence
  GFR-binding peptide
  MOD_RES (6)..(7): Xaa is C or S
KASKAXXVPTKLSPINILYF

SEQ ID NO: 5164 - protein, 17 aa, Artificial Sequence
  GFR-binding peptide
  MOD_RES (3)..(4): Xaa is C or S
KAXXVPTKLNAISVLYF

SEQ ID NO: 5165 - protein, 15 aa, Artificial Sequence
  GFR-binding peptide
  MOD_RES (1)..(2): Xaa is C or S
XXTPTKMNAISMLYF

SEQ ID NO: 5166 - protein, 17 aa, Artificial Sequence
  GFR-binding peptide
  MOD_RES (3)..(4): Xaa is C or S
KPXXAPTKLEPISVLYL

SEQ ID NO: 5167 - protein, 15 aa, Artificial Sequence
  GFR-binding peptide
  MOD_RES (1)..(2): Xaa is C or S
XXVPQDLNAISILYF

SEQ ID NO: 5168 - protein, 17 aa, Artificial Sequence
  GFR-binding peptide
  MOD_RES (3)..(4): Xaa is C or S
EPXXVPEKMSPINILYF

SEQ ID NO: 5169 - protein, 14 aa, Artificial Sequence
  GFR-binding peptide
  MOD_RES (1)..(1): Xaa is C or S
XVPTELSPISMLYK

SEQ ID NO: 5170 - protein, 18 aa, Artificial Sequence
  GFR-binding peptide
  MOD_RES (4)..(5): Xaa is C or S
PEPXXVPEKMNAISILYF

SEQ ID NO: 5171 - protein, 15 aa, Artificial Sequence
  GFR-binding peptide
  MOD_RES (1)..(2): Xaa is C or S
XXVPTRLSPISILYK

SEQ ID NO: 5172 - protein, 17 aa, Artificial Sequence
  GFR-binding peptide
  MOD_RES (3)..(4): Xaa is C or S
SPXXVSQDLSATSILYY

SEQ ID NO: 5173 - protein, 12 aa, Artificial Sequence
  GFR-binding peptide
PQALSPINILYF

SEQ ID NO: 5174 - protein, 9 aa, Artificial Sequence
  GFR-binding peptide
MEPISMLYL

SEQ ID NO: 5175 - protein, 16 aa, Artificial Sequence
  GFR-binding peptide
  MOD_RES (2)..(3): Xaa is C or S
TXXVPTRLNAISILYF

SEQ ID NO: 5176 - protein, 11 aa, Artificial Sequence
  GFR-binding peptide
QDLSATSILYY

SEQ ID NO: 5177 - protein, 12 aa, Artificial Sequence
  GFR-binding peptide
PTELSATSMLYY

SEQ ID NO: 5178 - protein, 20 aa, Artificial Sequence
  GFR-binding peptide
  MOD_RES (6)..(7): Xaa is C or S
GSAGPXXTPTKMSATSMLYY

SEQ ID NO: 5179 - protein, 16 aa, Artificial Sequence
  GFR-binding peptide
  MOD_RES (2)..(3): Xaa is C or S
PXXVPEKMSPINILYF

SEQ ID NO: 5180 - protein, 18 aa, Artificial Sequence
  GFR-binding peptide
  MOD_RES (4)..(5): Xaa is C or S
ASPXXVPQDLEPISILYL

SEQ ID NO: 5181 - protein, 11 aa, Artificial Sequence
  GFR-binding peptide
QDLSPINILYF

SEQ ID NO: 5182 - protein, 13 aa, Artificial Sequence
  GFR-binding peptide
VPTRLSPISILYK

SEQ ID NO: 5183 - protein, 16 aa, Artificial Sequence
  GFR-binding peptide
  MOD_RES (2)..(3): Xaa is C or S
AXXVPTKLSPINVLYF

SEQ ID NO: 5184 - protein, 17 aa, Artificial Sequence
  GFR-binding peptide
  MOD_RES (3)..(4): Xaa is C or S
KAXXVPTELEPISMLYL

SEQ ID NO: 5185 - protein, 12 aa, Artificial Sequence
  GFR-binding peptide
PARLSPISILYK

SEQ ID NO: 5186 - protein, 19 aa, Artificial Sequence
  GFR-binding peptide
  MOD_RES (5)..(6): Xaa is C or S
ASKAXXVPTKLSATSILYY

SEQ ID NO: 5187 - protein, 15 aa, Artificial Sequence
  GFR-binding peptide
  MOD_RES (2)..(2): Xaa is C or S
TXAPTKLSPISVLYK

SEQ ID NO: 5188 - protein, 16 aa, Artificial Sequence
  GFR-binding peptide
  MOD_RES (2)..(3): Xaa is C or S
AXXVPTKLSPINILYF

SEQ ID NO: 5189 - protein, 14 aa, Artificial Sequence
  GFR-binding peptide
  MOD_RES (1)..(1): Xaa is C or S
XVSQDLNAISILYF

SEQ ID NO: 5190 - protein, 13 aa, Artificial Sequence
  GFR-binding peptide
APTKLEPISVLYL

SEQ ID NO: 5191 - protein, 15 aa, Artificial Sequence
  GFR-binding peptide
  MOD_RES (1)..(2): Xaa is C or S
XXVPTELSPISMLYK

SEQ ID NO: 5192 - protein, 14 aa, Artificial Sequence
  GFR-binding peptide
  MOD_RES (1)..(1): Xaa is C or S
XVPQDLNAISILYF

SEQ ID NO: 5193 - protein, 13 aa, Artificial Sequence
  GFR-binding peptide
VPQDLNAISILYF

SEQ ID NO: 5194 - protein, 12 aa, Artificial Sequence
  GFR-binding peptide
SQDLSPINILYF

SEQ ID NO: 5195 - protein, 15 aa, Artificial Sequence
  GFR-binding peptide
  MOD_RES (1)..(2): Xaa is C or S
XXVSQDLSATSILYY

SEQ ID NO: 5196 - protein, 15 aa, Artificial Sequence
  GFR-binding peptide
  MOD_RES (1)..(2): Xaa is C or S
XXAPTKLSPINVLYF

SEQ ID NO: 5197 - protein, 16 aa, Artificial Sequence
  GFR-binding peptide
  MOD_RES (2)..(3): Xaa is C or S
AXXVPTKLNAISVLYF

SEQ ID NO: 5198 - protein, 13 aa, Artificial Sequence
  GFR-binding peptide
APVKTSPISMLYK

SEQ ID NO: 5199 - protein, 16 aa, Artificial Sequence
  GFR-binding peptide
  MOD_RES (2)..(3): Xaa is C or S
PXXVSQDLSPISILYK

SEQ ID NO: 5200 - protein, 14 aa, Artificial Sequence
  GFR-binding peptide
  MOD_RES (1)..(1): Xaa is C or S
XAPTKLEPISVLYL

SEQ ID NO: 5201 - protein, 10 aa, Artificial Sequence
  GFR-binding peptide
DLNAISILYF

SEQ ID NO: 5202 - protein, 18 aa, Artificial Sequence
  GFR-binding peptide
  MOD_RES (4)..(5): Xaa is C or S
PSTXXAPVKTNAISMLYF

SEQ ID NO: 5203 - protein, 17 aa, Artificial Sequence
  GFR-binding peptide
  MOD_RES (3)..(4): Xaa is C or S
STXXAPVKTSPINMLYF

SEQ ID NO: 5204 - protein, 20 aa, Artificial Sequence
  GFR-binding peptide
  MOD_RES (6)..(7): Xaa is C or S
ASAAPXXVPQALSPINILYF

SEQ ID NO: 5205 - protein, 18 aa, Artificial Sequence
  GFR-binding peptide
  MOD_RES (4)..(5): Xaa is C or S
SKAXXVPTKLSPISILYK

SEQ ID NO: 5206 - protein, 16 aa, Artificial Sequence
  GFR-binding peptide
  MOD_RES (2)..(3): Xaa is C or S
PXXAPTQLSPINVLYF

SEQ ID NO: 5207 - protein, 18 aa, Artificial Sequence
  GFR-binding peptide
  MOD_RES (4)..(5): Xaa is C or S
ASPXXVSQDLNAISILYF

SEQ ID NO: 5208 - protein, 18 aa, Artificial Sequence
  GFR-binding peptide
  MOD_RES (4)..(5): Xaa is C or S
PKAXXAPTKLSPINVLYF

SEQ ID NO: 5209 - protein, 19 aa, Artificial Sequence
  GFR-binding peptide
  MOD_RES (5)..(6): Xaa is C or S
APASXXVPARLSPINILYF

SEQ ID NO: 5210 - protein, 14 aa, Artificial Sequence
  GFR-binding peptide
  MOD_RES (1)..(1): Xaa is C or S
XVPARLSPISILYK

SEQ ID NO: 5211 - protein, 12 aa, Artificial Sequence
  GFR-binding peptide
PVKTNAISMLYF

SEQ ID NO: 5212 - protein, 11 aa, Artificial Sequence
  GFR-binding peptide
TRLSPISILYK

SEQ ID NO: 5213 - protein, 20 aa, Artificial Sequence
  GFR-binding peptide
  MOD_RES (6)..(7): Xaa is C or S
KIPKAXXVPTELEPISMLYL

SEQ ID NO: 5214 - protein, 14 aa, Artificial Sequence
  GFR-binding peptide
  MOD_RES (1)..(1): Xaa is C or S
XTPTKMNAISMLYF

SEQ ID NO: 5215 - protein, 16 aa, Artificial Sequence
  GFR-binding peptide
  MOD_RES (2)..(3): Xaa is C or S
AXXVPTKLEPISVLYL

SEQ ID NO: 5216 - protein, 12 aa, Artificial Sequence
  GFR-binding peptide
PTQLSATSVLYY

SEQ ID NO: 5217 - protein, 18 aa, Artificial Sequence
  GFR-binding peptide
  MOD_RES (4)..(5): Xaa is C or S
PKPXXAPTQLEPISVLYL

SEQ ID NO: 5218 - protein, 17 aa, Artificial Sequence
  GFR-binding peptide
  MOD_RES (3)..(4): Xaa is C or S
KAXXVPTKLNAISILYF

SEQ ID NO: 5219 - protein, 17 aa, Artificial Sequence
  GFR-binding peptide
  MOD_RES (3)..(4): Xaa is C or S
KPXXAPTKLSPINVLYF

SEQ ID NO: 5220 - protein, 17 aa, Artificial Sequence
  GFR-binding peptide
  MOD_RES (3)..(4): Xaa is C or S
PTXXVPTRLSPISILYK

SEQ ID NO: 5221 - protein, 19 aa, Artificial Sequence
  GFR-binding peptide
  MOD_RES (5)..(6): Xaa is C or S
VGKAXXVPTKLSPINVLYF

SEQ ID NO: 5222 - protein, 20 aa, Artificial Sequence
  GFR-binding peptide
  MOD_RES (6)..(7): Xaa is C or S
AAPASXXVPARLSPISILYK

SEQ ID NO: 5223 - protein, 19 aa, Artificial Sequence
  GFR-binding peptide
  MOD_RES (5)..(6): Xaa is C or S
SAGPXXTPTKMSPISMLYK

SEQ ID NO: 5224 - protein, 16 aa, Artificial Sequence
  GFR-binding peptide
  MOD_RES (2)..(3): Xaa is C or S
SXXVPARLEPISILYL

SEQ ID NO: 5225 - protein, 11 aa, Artificial Sequence
  GFR-binding peptide
TKLNAISILYF

SEQ ID NO: 5226 - protein, 20 aa, Artificial Sequence
  GFR-binding peptide
  MOD_RES (7)..(7): Xaa is C or S
HVTKPTXAPTKLSPINVLYF

SEQ ID NO: 5227 - protein, 19 aa, Artificial Sequence
  GFR-binding peptide
  MOD_RES (5)..(6): Xaa is C or S
IPKAXXVPTELSATSMLYY

SEQ ID NO: 5228 - protein, 19 aa, Artificial Sequence
  GFR-binding peptide
  MOD_RES (6)..(6): Xaa is C or S
VTKPTXAPTKLEPISVLYL

SEQ ID NO: 5229 - protein, 9 aa, Artificial Sequence
  GFR-binding peptide
LNAISILYF

SEQ ID NO: 5230 - protein, 9 aa, Artificial Sequence
  GFR-binding peptide
MSATSMLYY

SEQ ID NO: 5231 - protein, 17 aa, Artificial Sequence
  GFR-binding peptide
  MOD_RES (3)..(4): Xaa is C or S
SPXXVSQDLSPISILYK

SEQ ID NO: 5232 - protein, 16 aa, Artificial Sequence
  GFR-binding peptide
  MOD_RES (2)..(3): Xaa is C or S
PXXVPEKMEPISILYL

SEQ ID NO: 5233 - protein, 14 aa, Artificial Sequence
  GFR-binding peptide
  MOD_RES (1)..(1): Xaa is C or S
XVPQALNAISILYF

SEQ ID NO: 5234 - protein, 19 aa, Artificial Sequence
  GFR-binding peptide
  MOD_RES (5)..(6): Xaa is C or S
IPEPXXVPEKMSPINILYF

SEQ ID NO: 5235 - protein, 15 aa, Artificial Sequence
  GFR-binding peptide
  MOD_RES (1)..(2): Xaa is C or S
XXTPTKMSATSMLYY

SEQ ID NO: 5236 - protein, 20 aa, Artificial Sequence
  GFR-binding peptide
  MOD_RES (6)..(7): Xaa is C or S
GSAGPXXTPTKMEPISMLYL

SEQ ID NO: 5237 - protein, 20 aa, Artificial Sequence
  GFR-binding peptide
  MOD_RES (6)..(7): Xaa is C or S
AAPASXXVPARLNAISILYF

SEQ ID NO: 5238 - protein, 13 aa, Artificial Sequence
  GFR-binding peptide
VPTRLSPINILYF

SEQ ID NO: 5239 - protein, 18 aa, Artificial Sequence
  GFR-binding peptide
  MOD_RES (4)..(5): Xaa is C or S
ASPXXVSQDLEPISILYL

SEQ ID NO: 5240 - protein, 10 aa, Artificial Sequence
  GFR-binding peptide
ELEPISMLYL

SEQ ID NO: 5241 - protein, 19 aa, Artificial Sequence
  GFR-binding peptide
  MOD_RES (5)..(6): Xaa is C or S
IPKAXXVPTELSPISMLYK

SEQ ID NO: 5242 - protein, 17 aa, Artificial Sequence
  GFR-binding peptide
  MOD_RES (3)..(4): Xaa is C or S
ASXXVPARLSPISILYK

SEQ ID NO: 5243 - protein, 11 aa, Artificial Sequence
  GFR-binding peptide
TKMEPISMLYL

SEQ ID NO: 5244 - protein, 12 aa, Artificial Sequence
  GFR-binding peptide
PTELNAISMLYF

SEQ ID NO: 5245 - protein, 12 aa, Artificial Sequence
  GFR-binding peptide
PQALEPISILYL

SEQ ID NO: 5246 - protein, 15 aa, Artificial Sequence
  GFR-binding peptide
  MOD_RES (1)..(2): Xaa is C or S
XXVPQALSPINILYF

SEQ ID NO: 5247 - protein, 12 aa, Artificial Sequence
  GFR-binding peptide
PTKLSPISILYK

SEQ ID NO: 5248 - protein, 17 aa, Artificial Sequence
  GFR-binding peptide
  MOD_RES (3)..(4): Xaa is C or S
SPXXVPQDLSATSILYY

SEQ ID NO: 5249 - protein, 20 aa, Artificial Sequence
  GFR-binding peptide
  MOD_RES (6)..(7): Xaa is C or S
TVPKPXXAPTQLSPINVLYF

SEQ ID NO: 5250 - protein, 16 aa, Artificial Sequence
  GFR-binding peptide
  MOD_RES (2)..(3): Xaa is C or S
AXXVPTELSPISMLYK

SEQ ID NO: 5251 - protein, 18 aa, Artificial Sequence
  GFR-binding peptide
  MOD_RES (4)..(5): Xaa is C or S
ASPXXVPQDLSPINILYF

SEQ ID NO: 5252 - protein, 18 aa, Artificial Sequence
  GFR-binding peptide
  MOD_RES (4)..(5): Xaa is C or S
PSTXXAPVKTSATSMLYY

SEQ ID NO: 5253 - protein, 18 aa, Artificial Sequence
  GFR-binding peptide
  MOD_RES (5)..(5): Xaa is C or S
TKPTXAPTKLSATSVLYY

SEQ ID NO: 5254 - protein, 13 aa, Artificial Sequence
  GFR-binding peptide
VPTELSPISMLYK

SEQ ID NO: 5255 - protein, 11 aa, Artificial Sequence
  GFR-binding peptide
ARLSPISILYK

SEQ ID NO: 5256 - protein, 13 aa, Artificial Sequence
  GFR-binding peptide
VPEKMEPISILYL

SEQ ID NO: 5257 - protein, 13 aa, Artificial Sequence
  GFR-binding peptide
VPTKLNAISVLYF

SEQ ID NO: 5258 - protein, 14 aa, Artificial Sequence
  GFR-binding peptide
  MOD_RES (1)..(1): Xaa is C or S
XVSQDLSPISILYK

SEQ ID NO: 5259 - protein, 18 aa, Artificial Sequence
  GFR-binding peptide
  MOD_RES (4)..(5): Xaa is C or S
PASXXVPARLSATSILYY

SEQ ID NO: 5260 - protein, 19 aa, Artificial Sequence
  GFR-binding peptide
  MOD_RES (5)..(6): Xaa is C or S
VPKAXXAPTKLNAISVLYF

SEQ ID NO: 5261 - protein, 19 aa, Artificial Sequence
  GFR-binding peptide
  MOD_RES (5)..(6): Xaa is C or S
SASPXXVPQDLNAISILYF

SEQ ID NO: 5262 - protein, 19 aa, Artificial Sequence
  GFR-binding peptide
  MOD_RES (5)..(6): Xaa is C or S
VPKAXXAPTKLSPISVLYK

SEQ ID NO: 5263 - protein, 16 aa, Artificial Sequence
  GFR-binding peptide
  MOD_RES (2)..(3): Xaa is C or S
AXXVPTELNAISMLYF

SEQ ID NO: 5264 - protein, 17 aa, Artificial Sequence
  GFR-binding peptide
  MOD_RES (3)..(4): Xaa is C or S
APXXVPQALSATSILYY

SEQ ID NO: 5265 - protein, 11 aa, Artificial Sequence
  GFR-binding peptide
ARLNAISILYF

SEQ ID NO: 5266 - protein, 9 aa, Artificial Sequence
  GFR-binding peptide
MSPINILYF

SEQ ID NO: 5267 - protein, 10 aa, Artificial Sequence
  GFR-binding peptide
KTSPINMLYF

SEQ ID NO: 5268 - protein, 18 aa, Artificial Sequence
  GFR-binding peptide
  MOD_RES (4)..(5): Xaa is C or S
PPTXXVPTRLSPINILYF

SEQ ID NO: 5269 - protein, 18 aa, Artificial Sequence
  GFR-binding peptide
  MOD_RES (4)..(5): Xaa is C or S
AAPXXVPQALSPINILYF

SEQ ID NO: 5270 - protein, 16 aa, Artificial Sequence
  GFR-binding peptide
  MOD_RES (2)..(3): Xaa is C or S
AXXVPTKLSPISILYK

SEQ ID NO: 5271 - protein, 16 aa, Artificial Sequence
  GFR-binding peptide
  MOD_RES (2)..(3): Xaa is C or S
AXXAPTKLSPINVLYF

SEQ ID NO: 5272 - protein, 15 aa, Artificial Sequence
  GFR-binding peptide
  MOD_RES (1)..(2): Xaa is C or S
XXVPEKMSPINILYF

SEQ ID NO: 5273 - protein, 13 aa, Artificial Sequence
  GFR-binding peptide
VPQALEPISILYL

SEQ ID NO: 5274 - protein, 13 aa, Artificial Sequence
  GFR-binding peptide
VPARLSPINILYF

SEQ ID NO: 5275 - protein, 15 aa, Artificial Sequence
  GFR-binding peptide
  MOD_RES (1)..(2): Xaa is C or S
XXVPARLEPISILYL

SEQ ID NO: 5276 - protein, 16 aa, Artificial Sequence
  GFR-binding peptide
  MOD_RES (2)..(3): Xaa is C or S
AXXVPTKLSATSILYY

SEQ ID NO: 5277 - protein, 19 aa, Artificial Sequence
  GFR-binding peptide
  MOD_RES (5)..(6): Xaa is C or S
SAGPXXTPTKMSATSMLYY

SEQ ID NO: 5278 - protein, 18 aa, Artificial Sequence
  GFR-binding peptide
  MOD_RES (4)..(5): Xaa is C or S
PKAXXAPTKLEPISVLYL

SEQ ID NO: 5279 - protein, 12 aa, Artificial Sequence
  GFR-binding peptide
PEKMSATSILYY

SEQ ID NO: 5280 - protein, 19 aa, Artificial Sequence
  GFR-binding peptide
  MOD_RES (5)..(6): Xaa is C or S
ASKAXXVPTKLSPISILYK

SEQ ID NO: 5281 - protein, 12 aa, Artificial Sequence
  GFR-binding peptide
PTRLSPINILYF

SEQ ID NO: 5282 - protein, 11 aa, Artificial Sequence
  GFR-binding peptide
EKMSPINILYF

SEQ ID NO: 5283 - protein, 11 aa, Artificial Sequence
  GFR-binding peptide
VKTSPINMLYF

SEQ ID NO: 5284 - protein, 17 aa, Artificial Sequence
  GFR-binding peptide
  MOD_RES (3)..(4): Xaa is C or S
KPXXAPTKLSATSVLYY

SEQ ID NO: 5285 - protein, 18 aa, Artificial Sequence
  GFR-binding peptide
  MOD_RES (4)..(5): Xaa is C or S
GKAXXVPTKLSPINVLYF

SEQ ID NO: 5286 - protein, 19 aa, Artificial Sequence
  GFR-binding peptide
  MOD_RES (5)..(6): Xaa is C or S
VPSTXXAPVKTSPINMLYF

SEQ ID NO: 5287 - protein, 15 aa, Artificial Sequence
  GFR-binding peptide
  MOD_RES (1)..(2): Xaa is C or S
XXAPTQLSPINVLYF

SEQ ID NO: 5288 - protein, 13 aa, Artificial Sequence
  GFR-binding peptide
TPTKMNAISMLYF

SEQ ID NO: 5289 - protein, 11 aa, Artificial Sequence
  GFR-binding peptide
TRLSATSILYY

SEQ ID NO: 5290 - protein, 20 aa, Artificial Sequence
  GFR-binding peptide
  MOD_RES (6)..(7): Xaa is C or S
RVPSTXXAPVKTNAISMLYF

SEQ ID NO: 5291 - protein, 16 aa, Artificial Sequence
  GFR-binding peptide
  MOD_RES (2)..(3): Xaa is C or S
AXXAPTKLSPISVLYK

SEQ ID NO: 5292 - protein, 12 aa, Artificial Sequence
  GFR-binding peptide
SQDLEPISILYL

SEQ ID NO: 5293 - protein, 20 aa, Artificial Sequence
  GFR-binding peptide
  MOD_RES (6)..(7): Xaa is C or S
GIPEPXXVPEKMSPISILYK

SEQ ID NO: 5294 - protein, 14 aa, Artificial Sequence
  GFR-binding peptide
  MOD_RES (1)..(1): Xaa is C or S
XVPTRLNAISILYF

SEQ ID NO: 5295 - protein, 12 aa, Artificial Sequence
  GFR-binding peptide
PTKLNAISILYF

SEQ ID NO: 5296 - protein, 14 aa, Artificial Sequence
  GFR-binding peptide
  MOD_RES (1)..(1): Xaa is C or S
XAPVKTSPINMLYF

SEQ ID NO: 5297 - protein, 10 aa, Artificial Sequence
  GFR-binding peptide
RLSATSILYY

SEQ ID NO: 5298 - protein, 15 aa, Artificial Sequence
  GFR-binding peptide
  MOD_RES (1)..(2): Xaa is C or S
XXVSQDLSPINILYF

SEQ ID NO: 5299 - protein, 9 aa, Artificial Sequence
  GFR-binding peptide
MSPISMLYK

SEQ ID NO: 5300 - protein, 15 aa, Artificial Sequence
  GFR-binding peptide
  MOD_RES (1)..(2): Xaa is C or S
XXVPQDLSATSILYY

SEQ ID NO: 5301 - protein, 10 aa, Artificial Sequence
  GFR-binding peptide
ALEPISILYL

SEQ ID NO: 5302 - protein, 9 aa, Artificial Sequence
  GFR-binding peptide
TSATSMLYY

SEQ ID NO: 5303 - protein, 16 aa, Artificial Sequence
  GFR-binding peptide
  MOD_RES (2)..(3): Xaa is C or S
PXXVPQALSPINILYF

SEQ ID NO: 5304 - protein, 13 aa, Artificial Sequence
  GFR-binding peptide
VSQDLNAISILYF

SEQ ID NO: 5305 - protein, 16 aa, Artificial Sequence
  GFR-binding peptide
  MOD_RES (2)..(3): Xaa is C or S
PXXVPQDLSPISILYK

SEQ ID NO: 5306 - protein, 15 aa, Artificial Sequence
  GFR-binding peptide
  MOD_RES (1)..(2): Xaa is C or S
XXVSQDLSPISILYK

SEQ ID NO: 5307 - protein, 18 aa, Artificial Sequence
  GFR-binding peptide
  MOD_RES (4)..(5): Xaa is C or S
PASXXVPARLSPISILYK

SEQ ID NO: 5308 - protein, 11 aa, Artificial Sequence
  GFR-binding peptide
QALSPISILYK

SEQ ID NO: 5309 - protein, 19 aa, Artificial Sequence
  GFR-binding peptide
  MOD_RES (5)..(6): Xaa is C or S
TPPTXXVPTRLSPINILYF

SEQ ID NO: 5310 - protein, 17 aa, Artificial Sequence
  GFR-binding peptide
  MOD_RES (4)..(4): Xaa is C or S
KPTXAPTKLSPISVLYK

SEQ ID NO: 5311 - protein, 14 aa, Artificial Sequence
  GFR-binding peptide
  MOD_RES (1)..(1): Xaa is C or S
XVSQDLSATSILYY

SEQ ID NO: 5312 - protein, 19 aa, Artificial Sequence
  GFR-binding peptide
  MOD_RES (5)..(6): Xaa is C or S
ASKAXXVPTKLSPINILYF

SEQ ID NO: 5313 - protein, 13 aa, Artificial Sequence
  GFR-binding peptide
VPTELSATSMLYY

SEQ ID NO: 5314 - protein, 11 aa, Artificial Sequence
  GFR-binding peptide
VKTSPISMLYK

SEQ ID NO: 5315 - protein, 20 aa, Artificial Sequence
  GFR-binding peptide
  MOD_RES (6)..(7): Xaa is C or S
AVPKAXXAPTKLEPISVLYL

SEQ ID NO: 5316 - protein, 15 aa, Artificial Sequence
  GFR-binding peptide
  MOD_RES (1)..(2): Xaa is C or S
XXVPQALSPISILYK

SEQ ID NO: 5317 - protein, 12 aa, Artificial Sequence
  GFR-binding peptide
PEKMEPISILYL

SEQ ID NO: 5318 - protein, 18 aa, Artificial Sequence
  GFR-binding peptide
  MOD_RES (4)..(5): Xaa is C or S
PSTXXAPVKTSPISMLYK

SEQ ID NO: 5319 - protein, 14 aa, Artificial Sequence
  GFR-binding peptide
  MOD_RES (1)..(1): Xaa is C or S
XVPTKLSPINILYF

SEQ ID NO: 5320 - protein, 12 aa, Artificial Sequence
  GFR-binding peptide
PTKLEPISVLYL

SEQ ID NO: 5321 - protein, 15 aa, Artificial Sequence
  GFR-binding peptide
  MOD_RES (1)..(2): Xaa is C or S
XXAPVKTSPINMLYF

SEQ ID NO: 5322 - protein, 14 aa, Artificial Sequence
  GFR-binding peptide
  MOD_RES (1)..(1): Xaa is C or S
XAPTQLSPINVLYF

SEQ ID NO: 5323 - protein, 16 aa, Artificial Sequence
  GFR-binding peptide
  MOD_RES (2)..(3): Xaa is C or S
AXXVPTELSATSMLYY

SEQ ID NO: 5324 - protein, 10 aa, Artificial Sequence
  GFR-binding peptide
KMSPINILYF

SEQ ID NO: 5325 - protein, 19 aa, Artificial Sequence
  GFR-binding peptide
  MOD_RES (5)..(6): Xaa is C or S
SASPXXVSQDLNAISILYF

SEQ ID NO: 5326 - protein, 19 aa, Artificial Sequence
  GFR-binding peptide
  MOD_RES (5)..(6): Xaa is C or S
IPKAXXVPTELSPINMLYF

SEQ ID NO: 5327 - protein, 17 aa, Artificial Sequence
  GFR-binding peptide
  MOD_RES (4)..(4): Xaa is C or S
KPTXAPTKLSATSVLYY

SEQ ID NO: 5328 - protein, 11 aa, Artificial Sequence
  GFR-binding peptide
TKMSATSMLYY

SEQ ID NO: 5329 - protein, 18 aa, Artificial Sequence
  GFR-binding peptide
  MOD_RES (4)..(5): Xaa is C or S
AAPXXVPQALSPISILYK

SEQ ID NO: 5330 - protein, 14 aa, Artificial Sequence
  GFR-binding peptide
  MOD_RES (1)..(1): Xaa is C or S
XVPARLEPISILYL

SEQ ID NO: 5331 - protein, 20 aa, Artificial Sequence
  GFR-binding peptide
  MOD_RES (6)..(7): Xaa is C or S
RVPSTXXAPVKTEPISMLYL

SEQ ID NO: 5332 - protein, 13 aa, Artificial Sequence
  GFR-binding peptide
VPTKLSATSVLYY

SEQ ID NO: 5333 - protein, 11 aa, Artificial Sequence
  GFR-binding peptide
TELSPINMLYF

SEQ ID NO: 5334 - protein, 17 aa, Artificial Sequence
  GFR-binding peptide
  MOD_RES (3)..(4): Xaa is C or S
PTXXVPTRLSPINILYF

SEQ ID NO: 5335 - protein, 9 aa, Artificial Sequence
  GFR-binding peptide
LSPINMLYF

SEQ ID NO: 5336 - protein, 14 aa, Artificial Sequence
  GFR-binding peptide
  MOD_RES (1)..(1): Xaa is C or S
XTPTKMSATSMLYY

SEQ ID NO: 5337 - protein, 10 aa, Artificial Sequence
  GFR-binding peptide
KLNAISILYF

SEQ ID NO: 5338 - protein, 18 aa, Artificial Sequence
  GFR-binding peptide
  MOD_RES (4)..(5): Xaa is C or S
PKAXXVPTELSPINMLYF

SEQ ID NO: 5339 - protein, 18 aa, Artificial Sequence
  GFR-binding peptide
  MOD_RES (4)..(5): Xaa is C or S
PKPXXAPTQLSPISVLYK

SEQ ID NO: 5340 - protein, 13 aa, Artificial Sequence
  GFR-binding peptide
APTQLSPISVLYK

SEQ ID NO: 5341 - protein, 16 aa, Artificial Sequence
  GFR-binding peptide
  MOD_RES (2)..(3): Xaa is C or S
TXXAPVKTSATSMLYY

SEQ ID NO: 5342 - protein, 12 aa, Artificial Sequence
  GFR-binding peptide
PTKLSATSILYY

SEQ ID NO: 5343 - protein, 15 aa, Artificial Sequence
  GFR-binding peptide
  MOD_RES (1)..(2): Xaa is C or S
XXTPTKMSPISMLYK

SEQ ID NO: 5344 - protein, 13 aa, Artificial Sequence
  GFR-binding peptide
VPTKLSPISILYK

SEQ ID NO: 5345 - protein, 14 aa, Artificial Sequence
  GFR-binding peptide
  MOD_RES (1)..(1): Xaa is C or S
XVPQALSATSILYY

SEQ ID NO: 5346 - protein, 10 aa, Artificial Sequence
  GFR-binding peptide
RLSPISILYK

SEQ ID NO: 5347 - protein, 16 aa, Artificial Sequence
  GFR-binding peptide
  MOD_RES (2)..(3): Xaa is C or S
PXXVSQDLSPINILYF

SEQ ID NO: 5348 - protein, 20 aa, Artificial Sequence
  GFR-binding peptide
  MOD_RES (6)..(7): Xaa is C or S
ASAAPXXVPQALSATSILYY

SEQ ID NO: 5349 - protein, 17 aa, Artificial Sequence
  GFR-binding peptide
  MOD_RES (3)..(4): Xaa is C or S
STXXAPVKTSATSMLYY

SEQ ID NO: 5350 - protein, 18 aa, Artificial Sequence
  GFR-binding peptide
  MOD_RES (4)..(5): Xaa is C or S
PKPXXAPTKLSATSVLYY

SEQ ID NO: 5351 - protein, 13 aa, Artificial Sequence
  GFR-binding peptide
VSQDLEPISILYL

SEQ ID NO: 5352 - protein, 14 aa, Artificial Sequence
  GFR-binding peptide
  MOD_RES (1)..(1): Xaa is C or S
XVPTELSPINMLYF

SEQ ID NO: 5353 - protein, 14 aa, Artificial Sequence
  GFR-binding peptide
  MOD_RES (1)..(1): Xaa is C or S
XVPQDLSPISILYK

SEQ ID NO: 5354 - protein, 19 aa, Artificial Sequence
  GFR-binding peptide
  MOD_RES (5)..(6): Xaa is C or S
VPKPXXAPTQLSPINVLYF

SEQ ID NO: 5355 - protein, 13 aa, Artificial Sequence
  GFR-binding peptide
VPEKMSATSILYY

SEQ ID NO: 5356 - protein, 19 aa, Artificial Sequence
  GFR-binding peptide
  MOD_RES (5)..(6): Xaa is C or S
SAGPXXTPTKMEPISMLYL

SEQ ID NO: 5357 - protein, 10 aa, Artificial Sequence
  GFR-binding peptide
QLEPISVLYL

SEQ ID NO: 5358 - protein, 15 aa, Artificial Sequence
  GFR-binding peptide
  MOD_RES (1)..(2): Xaa is C or S
XXVPQDLSPISILYK

SEQ ID NO: 5359 - protein, 18 aa, Artificial Sequence
  GFR-binding peptide
  MOD_RES (4)..(5): Xaa is C or S
SKAXXVPTKLSPINILYF

SEQ ID NO: 5360 - protein, 13 aa, Artificial Sequence
  GFR-binding peptide
VPTELNAISMLYF

SEQ ID NO: 5361 - protein, 19 aa, Artificial Sequence
  GFR-binding peptide
  MOD_RES (5)..(6): Xaa is C or S
SAGPXXTPTKMNAISMLYF

SEQ ID NO: 5362 - protein, 20 aa, Artificial Sequence
  GFR-binding peptide
  MOD_RES (6)..(7): Xaa is C or S
ASAAPXXVPQALSPISILYK

SEQ ID NO: 5363 - protein, 18 aa, Artificial Sequence
  GFR-binding peptide
  MOD_RES (4)..(5): Xaa is C or S
PKPXXAPTQLSATSVLYY

SEQ ID NO: 5364 - protein, 17 aa, Artificial Sequence
  GFR-binding peptide
  MOD_RES (3)..(4): Xaa is C or S
KPXXAPTQLSATSVLYY

SEQ ID NO: 5365 - protein, 15 aa, Artificial Sequence
  GFR-binding peptide
  MOD_RES (1)..(2): Xaa is C or S
XXVPTKLSPINVLYF

SEQ ID NO: 5366 - protein, 15 aa, Artificial Sequence
  GFR-binding peptide
  MOD_RES (1)..(2): Xaa is C or S
XXVPTRLNAISILYF

SEQ ID NO: 5367 - protein, 19 aa, Artificial Sequence
  GFR-binding peptide
  MOD_RES (5)..(6): Xaa is C or S
SASPXXVSQDLEPISILYL

SEQ ID NO: 5368 - protein, 16 aa, Artificial Sequence
  GFR-binding peptide
  MOD_RES (2)..(3): Xaa is C or S
AXXVPTKLSATSVLYY

SEQ ID NO: 5369 - protein, 11 aa, Artificial Sequence
  GFR-binding peptide
TRLNAISILYF

SEQ ID NO: 5370 - protein, 17 aa, Artificial Sequence
  GFR-binding peptide
  MOD_RES (3)..(4): Xaa is C or S
KPXXAPTKLSPISVLYK

SEQ ID NO: 5371 - protein, 12 aa, Artificial Sequence
  GFR-binding peptide
PTELEPISMLYL

SEQ ID NO: 5372 - protein, 17 aa, Artificial Sequence
  GFR-binding peptide
  MOD_RES (3)..(4): Xaa is C or S
KPXXAPTQLSPISVLYK

SEQ ID NO: 5373 - protein, 14 aa, Artificial Sequence
  GFR-binding peptide
  MOD_RES (1)..(1): Xaa is C or S
XVPQDLSATSILYY

SEQ ID NO: 5374 - protein, 14 aa, Artificial Sequence
  GFR-binding peptide
  MOD_RES (1)..(1): Xaa is C or S
XVPQALSPISILYK

SEQ ID NO: 5375 - protein, 14 aa, Artificial Sequence
  GFR-binding peptide
  MOD_RES (1)..(1): Xaa is C or S
XVPARLNAISILYF

SEQ ID NO: 5376 - protein, 12 aa, Artificial Sequence
  GFR-binding peptide
PEKMNAISILYF

SEQ ID NO: 5377 - protein, 13 aa, Artificial Sequence
  GFR-binding peptide
APVKTEPISMLYL

SEQ ID NO: 5378 - protein, 17 aa, Artificial Sequence
  GFR-binding peptide
  MOD_RES (3)..(4): Xaa is C or S
SPXXVSQDLSPINILYF

SEQ ID NO: 5379 - protein, 16 aa, Artificial Sequence
  GFR-binding peptide
  MOD_RES (2)..(3): Xaa is C or S
TXXAPVKTSPISMLYK

SEQ ID NO: 5380 - protein, 9 aa, Artificial Sequence
  GFR-binding peptide
TSPISMLYK

SEQ ID NO: 5381 - protein, 18 aa, Artificial Sequence
  GFR-binding peptide
  MOD_RES (5)..(5): Xaa is C or S
TKPTXAPTKLSPISVLYK

SEQ ID NO: 5382 - protein, 15 aa, Artificial Sequence
  GFR-binding peptide
  MOD_RES (2)..(2): Xaa is C or S
TXAPTKLSPINVLYF

SEQ ID NO: 5383 - protein, 12 aa, Artificial Sequence
  GFR-binding peptide
PARLSPINILYF

SEQ ID NO: 5384 - protein, 18 aa, Artificial Sequence
  GFR-binding peptide
  MOD_RES (4)..(5): Xaa is C or S
PKPXXAPTKLSPISVLYK

SEQ ID NO: 5385 - protein, 13 aa, Artificial Sequence
  GFR-binding peptide
APTKLSPISVLYK

SEQ ID NO: 5386 - protein, 13 aa, Artificial Sequence
  GFR-binding peptide
APVKTNAISMLYF

SEQ ID NO: 5387 - protein, 20 aa, Artificial Sequence
  GFR-binding peptide
  MOD_RES (6)..(7): Xaa is C or S
YVPKPXXAPTKLEPISVLYL

SEQ ID NO: 5388 - protein, 20 aa, Artificial Sequence
  GFR-binding peptide
  MOD_RES (6)..(7): Xaa is C or S
ASASPXXVPQDLSPINILYF

SEQ ID NO: 5389 - protein, 11 aa, Artificial Sequence
  GFR-binding peptide
ARLSATSILYY

SEQ ID NO: 5390 - protein, 13 aa, Artificial Sequence
  GFR-binding peptide
VPTKLSATSILYY

SEQ ID NO: 5391 - protein, 19 aa, Artificial Sequence
  GFR-binding peptide
  MOD_RES (5)..(6): Xaa is C or S
SAAPXXVPQALSPINILYF

SEQ ID NO: 5392 - protein, 20 aa, Artificial Sequence
  GFR-binding peptide
  MOD_RES (6)..(7): Xaa is C or S
STPPTXXVPTRLSPINILYF

SEQ ID NO: 5393 - protein, 17 aa, Artificial Sequence
  GFR-binding peptide
  MOD_RES (3)..(4): Xaa is C or S
STXXAPVKTSPISMLYK

SEQ ID NO: 5394 - protein, 13 aa, Artificial Sequence
  GFR-binding peptide
APTQLSATSVLYY

SEQ ID NO: 5395 - protein, 15 aa, Artificial Sequence
  GFR-binding peptide
  MOD_RES (1)..(2): Xaa is C or S
XXVPTRLEPISILYL

SEQ ID NO: 5396 - protein, 12 aa, Artificial Sequence
  GFR-binding peptide
PTQLEPISVLYL

SEQ ID NO: 5397 - protein, 14 aa, Artificial Sequence
  GFR-binding peptide
  MOD_RES (1)..(1): Xaa is C or S
XTPTKMSPISMLYK

SEQ ID NO: 5398 - protein, 10 aa, Artificial Sequence
  GFR-binding peptide
KLEPISVLYL

SEQ ID NO: 5399 - protein, 14 aa, Artificial Sequence
  GFR-binding peptide
  MOD_RES (1)..(1): Xaa is C or S
XVPEKMSPINILYF

SEQ ID NO: 5400 - protein, 11 aa, Artificial Sequence
  GFR-binding peptide
QDLSNITIQIM

SEQ ID NO: 5401 - protein, 19 aa, Artificial Sequence
  GFR-binding peptide
  MOD_RES (5)..(6): Xaa is C or S
TPPTXXVPTRLSNITIQIM

SEQ ID NO: 5402 - protein, 13 aa, Artificial Sequence
  GFR-binding peptide
VPQALSNITIQIM

SEQ ID NO: 5403 - protein, 18 aa, Artificial Sequence
  GFR-binding peptide
  MOD_RES (3)..(3): Xaa is C or S
VQXRPTQVQLSNITVQIM

SEQ ID NO: 5404 - protein, 12 aa, Artificial Sequence
  GFR-binding peptide
RVHHSNITVQIM

SEQ ID NO: 5405 - protein, 14 aa, Artificial Sequence
  GFR-binding peptide
  MOD_RES (1)..(1): Xaa is C or S
XTPTKMSNITMQIM

SEQ ID NO: 5406 - protein, 10 aa, Artificial Sequence
  GFR-binding peptide
QLSNITVQIM

SEQ ID NO: 5407 - protein, 10 aa, Artificial Sequence
  GFR-binding peptide
KLSNITVQIM

SEQ ID NO: 5408 - protein, 9 aa, Artificial Sequence
  GFR-binding peptide
TSNITMQIM

SEQ ID NO: 5409 - protein, 15 aa, Artificial Sequence
  GFR-binding peptide
RPTQVQLSNITVQIM

SEQ ID NO: 5410 - protein, 16 aa, Artificial Sequence
  GFR-binding peptide
  MOD_RES (2)..(3): Xaa is C or S
TXXAPVKTSNITMQIM

SEQ ID NO: 5411 - protein, 12 aa, Artificial Sequence
  GFR-binding peptide
PARLSNITIQIM

SEQ ID NO: 5412 - protein, 20 aa, Artificial Sequence
  GFR-binding peptide
  MOD_RES (5)..(5): Xaa is C or S
RNVQXRPTQVQLSNITVQIM

SEQ ID NO: 5413 - protein, 15 aa, Artificial Sequence
  GFR-binding peptide
  MOD_RES (1)..(2): Xaa is C or S
XXVPQDLSNITIQIM

SEQ ID NO: 5414 - protein, 10 aa, Artificial Sequence
  GFR-binding peptide
RLSNITIQIM

SEQ ID NO: 5415 - protein, 13 aa, Artificial Sequence
  GFR-binding peptide
APTKLSNITVQIM

SEQ ID NO: 5416 - protein, 20 aa, Artificial Sequence
  GFR-binding peptide
  MOD_RES (6)..(7): Xaa is C or S
ASAAPXXVPQALSNITIQIM

SEQ ID NO: 5417 - protein, 11 aa, Artificial Sequence
  GFR-binding peptide
ARLSNITIQIM

SEQ ID NO: 5418 - protein, 19 aa, Artificial Sequence
  GFR-binding peptide
  MOD_RES (5)..(6): Xaa is C or S
SASPXXVSQDLSNITIQIM

SEQ ID NO: 5419 - protein, 13 aa, Artificial Sequence
  GFR-binding peptide
APVKTSNITMQIM

SEQ ID NO: 5420 - protein, 14 aa, Artificial Sequence
  GFR-binding peptide
  MOD_RES (1)..(1): Xaa is C or S
XVPQALSNITIQIM

SEQ ID NO: 5421 - protein, 18 aa, Artificial Sequence
  GFR-binding peptide
  MOD_RES (4)..(5): Xaa is C or S
AGPXXTPTKMSNITMQIM

SEQ ID NO: 5422 - protein, 13 aa, Artificial Sequence
  GFR-binding peptide
TQVQLSNITVQIM

SEQ ID NO: 5423 - protein, 16 aa, Artificial Sequence
  GFR-binding peptide
  MOD_RES (2)..(3): Xaa is C or S
PXXTPTKMSNITMQIM

SEQ ID NO: 5424 - protein, 11 aa, Artificial Sequence
  GFR-binding peptide
VQLSNITVQIM

SEQ ID NO: 5425 - protein, 15 aa, Artificial Sequence
  GFR-binding peptide
  MOD_RES (1)..(2): Xaa is C or S
XXVPARLSNITIQIM

SEQ ID NO: 5426 - protein, 12 aa, Artificial Sequence
  GFR-binding peptide
SQDLSNITIQIM

SEQ ID NO: 5427 - protein, 17 aa, Artificial Sequence
  GFR-binding peptide
  MOD_RES (2)..(2): Xaa is C or S
KXQPSRVHHSNITVQIM

SEQ ID NO: 5428 - protein, 16 aa, Artificial Sequence
  GFR-binding peptide
  MOD_RES (1)..(1): Xaa is C or S
XRPTQVQLSNITVQIM

SEQ ID NO: 5429 - protein, 14 aa, Artificial Sequence
  GFR-binding peptide
PSRVHHSNITVQIM

SEQ ID NO: 5430 - protein, 16 aa, Artificial Sequence
  GFR-binding peptide
  MOD_RES (2)..(3): Xaa is C or S
PXXVSQDLSNITIQIM

SEQ ID NO: 5431 - protein, 13 aa, Artificial Sequence
  GFR-binding peptide
VPTRLSNITIQIM

SEQ ID NO: 5432 - protein, 15 aa, Artificial Sequence
  GFR-binding peptide
  MOD_RES (1)..(2): Xaa is C or S
XXTPTKMSNITMQIM

SEQ ID NO: 5433 - protein, 16 aa, Artificial Sequence
  GFR-binding peptide
  MOD_RES (2)..(3): Xaa is C or S
SXXVPARLSNITIQIM

SEQ ID NO: 5434 - protein, 15 aa, Artificial Sequence
  GFR-binding peptide
  MOD_RES (1)..(2): Xaa is C or S
XXAPVKTSNITMQIM

SEQ ID NO: 5435 - protein, 10 aa, Artificial Sequence
  GFR-binding peptide
ALSNITIQIM

SEQ ID NO: 5436 - protein, 19 aa, Artificial Sequence
  GFR-binding peptide
  MOD_RES (5)..(6): Xaa is C or S
SASPXXVPQDLSNITIQIM

SEQ ID NO: 5437 - protein, 16 aa, Artificial Sequence
  GFR-binding peptide
  MOD_RES (2)..(3): Xaa is C or S
TXXVPTRLSNITIQIM

SEQ ID NO: 5438 - protein, 15 aa, Artificial Sequence
  GFR-binding peptide
  MOD_RES (1)..(2): Xaa is C or S
XXVPTRLSNITIQIM

SEQ ID NO: 5439 - protein, 13 aa, Artificial Sequence
  GFR-binding peptide
SRVHHSNITVQIM

SEQ ID NO: 5440 - protein, 18 aa, Artificial Sequence
  GFR-binding peptide
  MOD_RES (4)..(5): Xaa is C or S
PPTXXVPTRLSNITIQIM

SEQ ID NO: 5441 - protein, 10 aa, Artificial Sequence
  GFR-binding peptide
KMSNITMQIM

SEQ ID NO: 5442 - protein, 17 aa, Artificial Sequence
  GFR-binding peptide
  MOD_RES (3)..(4): Xaa is C or S
GPXXTPTKMSNITMQIM

SEQ ID NO: 5443 - protein, 15 aa, Artificial Sequence
  GFR-binding peptide
QPSRVHHSNITVQIM

SEQ ID NO: 5444 - protein, 13 aa, Artificial Sequence
  GFR-binding peptide
TPTKMSNITMQIM

SEQ ID NO: 5445 - protein, 14 aa, Artificial Sequence
  GFR-binding peptide
  MOD_RES (1)..(1): Xaa is C or S
XVPQDLSNITIQIM

SEQ ID NO: 5446 - protein, 12 aa, Artificial Sequence
  GFR-binding peptide
PQDLSNITIQIM

SEQ ID NO: 5447 - protein, 16 aa, Artificial Sequence
  GFR-binding peptide
  MOD_RES (2)..(3): Xaa is C or S
PXXAPTKLSNITVQIM

SEQ ID NO: 5448 - protein, 20 aa, Artificial Sequence
  GFR-binding peptide
  MOD_RES (5)..(5): Xaa is C or S
SSVKXQPSRVHHSNITVQIM

SEQ ID NO: 5449 - protein, 15 aa, Artificial Sequence
  GFR-binding peptide
  MOD_RES (1)..(2): Xaa is C or S
XXAPTKLSNITVQIM

SEQ ID NO: 5450 - protein, 11 aa, Artificial Sequence
  GFR-binding peptide
QALSNITIQIM

SEQ ID NO: 5451 - protein, 19 aa, Artificial Sequence
  GFR-binding peptide
  MOD_RES (5)..(6): Xaa is C or S
VPSTXXAPVKTSNITMQIM

SEQ ID NO: 5452 - protein, 10 aa, Artificial Sequence
  GFR-binding peptide
KTSNITMQIM

SEQ ID NO: 5453 - protein, 13 aa, Artificial Sequence
  GFR-binding peptide
VPQDLSNITIQIM

SEQ ID NO: 5454 - protein, 11 aa, Artificial Sequence
  GFR-binding peptide
VKTSNITMQIM

SEQ ID NO: 5455 - protein, 18 aa, Artificial Sequence
  GFR-binding peptide
  MOD_RES (4)..(5): Xaa is C or S
AAPXXVPQALSNITIQIM

SEQ ID NO: 5456 - protein, 17 aa, Artificial Sequence
  GFR-binding peptide
  MOD_RES (3)..(4): Xaa is C or S
ASXXVPARLSNITIQIM

SEQ ID NO: 5457 - protein, 11 aa, Artificial Sequence
  GFR-binding peptide
VHHSNITVQIM

SEQ ID NO: 5458 - protein, 13 aa, Artificial Sequence
  GFR-binding peptide
VSQDLSNITIQIM

SEQ ID NO: 5459 - protein, 18 aa, Artificial Sequence
  GFR-binding peptide
  MOD_RES (4)..(5): Xaa is C or S
PSTXXAPVKTSNITMQIM

SEQ ID NO: 5460 - protein, 18 aa, Artificial Sequence
  GFR-binding peptide
  MOD_RES (3)..(3): Xaa is C or S
VKXQPSRVHHSNITVQIM

SEQ ID NO: 5461 - protein, 14 aa, Artificial Sequence
  GFR-binding peptide
PTQVQLSNITVQIM

SEQ ID NO: 5462 - protein, 17 aa, Artificial Sequence
  GFR-binding peptide
  MOD_RES (3)..(4): Xaa is C or S
APXXVPQALSNITIQIM

SEQ ID NO: 5463 - protein, 10 aa, Artificial Sequence
  GFR-binding peptide
HHSNITVQIM

SEQ ID NO: 5464 - protein, 9 aa, Artificial Sequence
  GFR-binding peptide
LSNITIQIM

SEQ ID NO: 5465 - protein, 17 aa, Artificial Sequence
  GFR-binding peptide
  MOD_RES (3)..(4): Xaa is C or S
SPXXVSQDLSNITIQIM

SEQ ID NO: 5466 - protein, 17 aa, Artificial Sequence
  GFR-binding peptide
  MOD_RES (3)..(4): Xaa is C or S
STXXAPVKTSNITMQIM

SEQ ID NO: 5467 - protein, 18 aa, Artificial Sequence
  GFR-binding peptide
  MOD_RES (4)..(5): Xaa is C or S
ASPXXVSQDLSNITIQIM

SEQ ID NO: 5468 - protein, 15 aa, Artificial Sequence
  GFR-binding peptide
  MOD_RES (1)..(2): Xaa is C or S
XXVPQALSNITIQIM

SEQ ID NO: 5469 - protein, 20 aa, Artificial Sequence
  GFR-binding peptide
  MOD_RES (6)..(7): Xaa is C or S
GSAGPXXTPTKMSNITMQIM

SEQ ID NO: 5470 - protein, 14 aa, Artificial Sequence
  GFR-binding peptide
  MOD_RES (1)..(1): Xaa is C or S
XVPTRLSNITIQIM

SEQ ID NO: 5471 - protein, 18 aa, Artificial Sequence
  GFR-binding peptide
  MOD_RES (4)..(5): Xaa is C or S
PKPXXAPTKLSNITVQIM

SEQ ID NO: 5472 - protein, 12 aa, Artificial Sequence
  GFR-binding peptide
PQALSNITIQIM

SEQ ID NO: 5473 - protein, 12 aa, Artificial Sequence
  GFR-binding peptide
PTKLSNITVQIM

SEQ ID NO: 5474 - protein, 18 aa, Artificial Sequence
  GFR-binding peptide
  MOD_RES (4)..(5): Xaa is C or S
ASPXXVPQDLSNITIQIM

SEQ ID NO: 5475 - protein, 12 aa, Artificial Sequence
  GFR-binding peptide
PVKTSNITMQIM

SEQ ID NO: 5476 - protein, 12 aa, Artificial Sequence
  GFR-binding peptide
PTRLSNITIQIM

SEQ ID NO: 5477 - protein, 14 aa, Artificial Sequence
  GFR-binding peptide
  MOD_RES (1)..(1): Xaa is C or S
XVSQDLSNITIQIM

SEQ ID NO: 5478 - protein, 19 aa, Artificial Sequence
  GFR-binding peptide
  MOD_RES (5)..(6): Xaa is C or S
APASXXVPARLSNITIQIM

SEQ ID NO: 5479 - protein, 17 aa, Artificial Sequence
  GFR-binding peptide
  MOD_RES (2)..(2): Xaa is C or S
QXRPTQVQLSNITVQIM

SEQ ID NO: 5480 - protein, 13 aa, Artificial Sequence
  GFR-binding peptide
VPARLSNITIQIM

SEQ ID NO: 5481 - protein, 20 aa, Artificial Sequence
  GFR-binding peptide
  MOD_RES (6)..(7): Xaa is C or S
HVPKPXXAPTKLSNITVQIM

SEQ ID NO: 5482 - protein, 17 aa, Artificial Sequence
  GFR-binding peptide
  MOD_RES (3)..(4): Xaa is C or S
PTXXVPTRLSNITIQIM

SEQ ID NO: 5483 - protein, 20 aa, Artificial Sequence
  GFR-binding peptide
  MOD_RES (6)..(7): Xaa is C or S
ASASPXXVPQDLSNITIQIM

SEQ ID NO: 5484 - protein, 9 aa, Artificial Sequence
  GFR-binding peptide
MSNITMQIM

SEQ ID NO: 5485 - protein, 19 aa, Artificial Sequence
  GFR-binding peptide
  MOD_RES (5)..(6): Xaa is C or S
VPKPXXAPTKLSNITVQIM

SEQ ID NO: 5486 - protein, 19 aa, Artificial Sequence
  GFR-binding peptide
  MOD_RES (5)..(6): Xaa is C or S
SAAPXXVPQALSNITIQIM

SEQ ID NO: 5487 - protein, 17 aa, Artificial Sequence
  GFR-binding peptide
  MOD_RES (3)..(4): Xaa is C or S
KPXXAPTKLSNITVQIM

SEQ ID NO: 5488 - protein, 16 aa, Artificial Sequence
  GFR-binding peptide
  MOD_RES (2)..(3): Xaa is C or S
PXXVPQALSNITIQIM

SEQ ID NO: 5489 - protein, 20 aa, Artificial Sequence
  GFR-binding peptide
  MOD_RES (6)..(7): Xaa is C or S
STPPTXXVPTRLSNITIQIM

SEQ ID NO: 5490 - protein, 12 aa, Artificial Sequence
  GFR-binding peptide
PTKMSNITMQIM

SEQ ID NO: 5491 - protein, 10 aa, Artificial Sequence
  GFR-binding peptide
DLSNITIQIM

SEQ ID NO: 5492 - protein, 14 aa, Artificial Sequence
  GFR-binding peptide
  MOD_RES (1)..(1): Xaa is C or S
XVPARLSNITIQIM

SEQ ID NO: 5493 - protein, 16 aa, Artificial Sequence
  GFR-binding peptide
  MOD_RES (2)..(3): Xaa is C or S
PXXVPQDLSNITIQIM

SEQ ID NO: 5494 - protein, 14 aa, Artificial Sequence
  GFR-binding peptide
  MOD_RES (1)..(1): Xaa is C or S
XAPTKLSNITVQIM

SEQ ID NO: 5495 - protein, 20 aa, Artificial Sequence
  GFR-binding peptide
  MOD_RES (6)..(7): Xaa is C or S
ASASPXXVSQDLSNITIQIM

SEQ ID NO: 5496 - protein, 19 aa, Artificial Sequence
  GFR-binding peptide
  MOD_RES (4)..(4): Xaa is C or S
SVKXQPSRVHHSNITVQIM

SEQ ID NO: 5497 - protein, 18 aa, Artificial Sequence
  GFR-binding peptide
  MOD_RES (4)..(5): Xaa is C or S
PASXXVPARLSNITIQIM

SEQ ID NO: 5498 - protein, 9 aa, Artificial Sequence
  GFR-binding peptide
LSNITVQIM

SEQ ID NO: 5499 - protein, 19 aa, Artificial Sequence
  GFR-binding peptide
  MOD_RES (5)..(6): Xaa is C or S
SAGPXXTPTKMSNITMQIM

SEQ ID NO: 5500 - protein, 11 aa, Artificial Sequence
  GFR-binding peptide
TKMSNITMQIM

SEQ ID NO: 5501 - protein, 19 aa, Artificial Sequence
  GFR-binding peptide
  MOD_RES (4)..(4): Xaa is C or S
NVQXRPTQVQLSNITVQIM

SEQ ID NO: 5502 - protein, 15 aa, Artificial Sequence
  GFR-binding peptide
  MOD_RES (1)..(2): Xaa is C or S
XXVSQDLSNITIQIM

SEQ ID NO: 5503 - protein, 16 aa, Artificial Sequence
  GFR-binding peptide
  MOD_RES (1)..(1): Xaa is C or S
XQPSRVHHSNITVQIM

SEQ ID NO: 5504 - protein, 9 aa, Artificial Sequence
  GFR-binding peptide
HSNITVQIM

SEQ ID NO: 5505 - protein, 17 aa, Artificial Sequence
  GFR-binding peptide
  MOD_RES (3)..(4): Xaa is C or S
SPXXVPQDLSNITIQIM

SEQ ID NO: 5506 - protein, 20 aa, Artificial Sequence
  GFR-binding peptide
  MOD_RES (6)..(7): Xaa is C or S
AAPASXXVPARLSNITIQIM

SEQ ID NO: 5507 - protein, 14 aa, Artificial Sequence
  GFR-binding peptide
  MOD_RES (1)..(1): Xaa is C or S
XAPVKTSNITMQIM

SEQ ID NO: 5508 - protein, 11 aa, Artificial Sequence
  GFR-binding peptide
TKLSNITVQIM

SEQ ID NO: 5509 - protein, 12 aa, Artificial Sequence
  GFR-binding peptide
QVQLSNITVQIM

SEQ ID NO: 5510 - protein, 11 aa, Artificial Sequence
  GFR-binding peptide
TRLSNITIQIM

SEQ ID NO: 5511 - protein, 11 aa, Artificial Sequence
  GFR-binding peptide
MIQITINSLDQ

SEQ ID NO: 5512 - protein, 19 aa, Artificial Sequence
  GFR-binding peptide
  MOD_RES (14)..(15): Xaa is C or S
MIQITINSLRTPVXXTPPT

SEQ ID NO: 5513 - protein, 13 aa, Artificial Sequence
  GFR-binding peptide
MIQITINSLAQPV

SEQ ID NO: 5514 - protein, 18 aa, Artificial Sequence
  GFR-binding peptide
  MOD_RES (16)..(16): Xaa is C or S
MIQVTINSLQVQTPRXQV

SEQ ID NO: 5515 - protein, 12 aa, Artificial Sequence
  GFR-binding peptide
MIQVTINSHHVR

SEQ ID NO: 5516 - protein, 14 aa, Artificial Sequence
  GFR-binding peptide
  MOD_RES (14)..(14): Xaa is C or S
MIQMTINSMKTPTX

SEQ ID NO: 5517 - protein, 10 aa, Artificial Sequence
  GFR-binding peptide
MIQVTINSLQ

SEQ ID NO: 5518 - protein, 10 aa, Artificial Sequence
  GFR-binding peptide
MIQVTINSLK

SEQ ID NO: 5519 - protein, 9 aa, Artificial Sequence
  GFR-binding peptide
MIQMTINST

SEQ ID NO: 5520 - protein, 15 aa, Artificial Sequence
  GFR-binding peptide
  MOD_RES (14)..(14): Xaa is C or S
MIQMTINSEETPVXE

SEQ ID NO: 5521 - protein, 15 aa, Artificial Sequence
  GFR-binding peptide
MIQVTINSLQVQTPR

SEQ ID NO: 5522 - protein, 16 aa, Artificial Sequence
  GFR-binding peptide
  MOD_RES (14)..(15): Xaa is C or S
MIQMTINSTKVPAXXT

SEQ ID NO: 5523 - protein, 18 aa, Artificial Sequence
  GFR-binding peptide
  MOD_RES (14)..(14): Xaa is C or S
MIQMTINSEETPVXELGE

SEQ ID NO: 5524 - protein, 12 aa, Artificial Sequence
  GFR-binding peptide
MIQITINSLRAP

SEQ ID NO: 5525 - protein, 20 aa, Artificial Sequence
  GFR-binding peptide
  MOD_RES (16)..(16): Xaa is C or S
MIQVTINSLQVQTPRXQVNR

SEQ ID NO: 5526 - protein, 15 aa, Artificial Sequence
  GFR-binding peptide
  MOD_RES (14)..(15): Xaa is C or S
MIQITINSLDQPVXX

SEQ ID NO: 5527 - protein, 10 aa, Artificial Sequence
  GFR-binding peptide
MIQITINSLR

SEQ ID NO: 5528 - protein, 13 aa, Artificial Sequence
  GFR-binding peptide
MIQVTINSLKTPA

SEQ ID NO: 5529 - protein, 20 aa, Artificial Sequence
  GFR-binding peptide
  MOD_RES (14)..(15): Xaa is C or S
MIQITINSLAQPVXXPAASA

SEQ ID NO: 5530 - protein, 11 aa, Artificial Sequence
  GFR-binding peptide
MIQITINSLRA

SEQ ID NO: 5531 - protein, 19 aa, Artificial Sequence
  GFR-binding peptide
  MOD_RES (14)..(15): Xaa is C or S
MIQITINSLDQSVXXPSAS

SEQ ID NO: 5532 - protein, 13 aa, Artificial Sequence
  GFR-binding peptide
MIQMTINSTKVPA

SEQ ID NO: 5533 - protein, 14 aa, Artificial Sequence
  GFR-binding peptide
  MOD_RES (14)..(14): Xaa is C or S
MIQITINSLAQPVX

SEQ ID NO: 5534 - protein, 18 aa, Artificial Sequence
  GFR-binding peptide
  MOD_RES (14)..(15): Xaa is C or S
MIQMTINSMKTPTXXPGA

SEQ ID NO: 5535 - protein, 17 aa, Artificial Sequence
  GFR-binding peptide
  MOD_RES (14)..(14): Xaa is C or S
MIQMTINSEETPVXELG

SEQ ID NO: 5536 - protein, 13 aa, Artificial Sequence
  GFR-binding peptide
MIQVTINSLQVQT

SEQ ID NO: 5537 - protein, 16 aa, Artificial Sequence
  GFR-binding peptide
  MOD_RES (14)..(15): Xaa is C or S
MIQMTINSMKTPTXXP

SEQ ID NO: 5538 - protein, 11 aa, Artificial Sequence
  GFR-binding peptide
MIQVTINSLQV

SEQ ID NO: 5539 - protein, 15 aa, Artificial Sequence
  GFR-binding peptide
  MOD_RES (14)..(15): Xaa is C or S
MIQITINSLRAPVXX

SEQ ID NO: 5540 - protein, 20 aa, Artificial Sequence
  GFR-binding peptide
  MOD_RES (14)..(14): Xaa is C or S
MIQMTINSEETPVXELGEDN

SEQ ID NO: 5541 - protein, 12 aa, Artificial Sequence
  GFR-binding peptide
MIQITINSLDQS

SEQ ID NO: 5542 - protein, 9 aa, Artificial Sequence
  GFR-binding peptide
MIQMTINSE

SEQ ID NO: 5543 - protein, 17 aa, Artificial Sequence
  GFR-binding peptide
  MOD_RES (16)..(16): Xaa is C or S
MIQVTINSHHVRSPQXK

SEQ ID NO: 5544 - protein, 16 aa, Artificial Sequence
  GFR-binding peptide
  MOD_RES (16)..(16): Xaa is C or S
MIQVTINSLQVQTPRX

SEQ ID NO: 5545 - protein, 14 aa, Artificial Sequence
  GFR-binding peptide
MIQVTINSHHVRSP

SEQ ID NO: 5546 - protein, 11 aa, Artificial Sequence
  GFR-binding peptide
MIQMTINSQGT

SEQ ID NO: 5547 - protein, 16 aa, Artificial Sequence
  GFR-binding peptide
  MOD_RES (14)..(15): Xaa is C or S
MIQITINSLDQSVXXP

SEQ ID NO: 5548 - protein, 13 aa, Artificial Sequence
  GFR-binding peptide
MIQITINSLRTPV

SEQ ID NO: 5549 - protein, 15 aa, Artificial Sequence
  GFR-binding peptide
  MOD_RES (14)..(15): Xaa is C or S
MIQMTINSMKTPTXX

SEQ ID NO: 5550 - protein, 16 aa, Artificial Sequence
  GFR-binding peptide
  MOD_RES (14)..(15): Xaa is C or S
MIQITINSLRAPVXXS

SEQ ID NO: 5551 - protein, 11 aa, Artificial Sequence
  GFR-binding peptide
MIQMTINSEET

SEQ ID NO: 5552 - protein, 15 aa, Artificial Sequence
  GFR-binding peptide
  MOD_RES (14)..(15): Xaa is C or S
MIQMTINSTKVPAXX

SEQ ID NO: 5553 - protein, 10 aa, Artificial Sequence
  GFR-binding peptide
MIQITINSLA

SEQ ID NO: 5554 - protein, 19 aa, Artificial Sequence
  GFR-binding peptide
  MOD_RES (14)..(15): Xaa is C or S
MIQITINSLDQPVXXPSAS

SEQ ID NO: 5555 - protein, 16 aa, Artificial Sequence
  GFR-binding peptide
  MOD_RES (14)..(15): Xaa is C or S
MIQITINSLRTPVXXT

SEQ ID NO: 5556 - protein, 16 aa, Artificial Sequence
  GFR-binding peptide
  MOD_RES (14)..(14): Xaa is C or S
MIQMTINSEETPVXEL

SEQ ID NO: 5557 - protein, 15 aa, Artificial Sequence
  GFR-binding peptide
  MOD_RES (14)..(15): Xaa is C or S
MIQITINSLRTPVXX

SEQ ID NO: 5558 - protein, 13 aa, Artificial Sequence
  GFR-binding peptide
MIQVTINSHHVRS

SEQ ID NO: 5559 - protein, 14 aa, Artificial Sequence
  GFR-binding peptide
  MOD_RES (14)..(14): Xaa is C or S
MIQMTINSEETPVX

SEQ ID NO: 5560 - protein, 18 aa, Artificial Sequence
  GFR-binding peptide
  MOD_RES (14)..(15): Xaa is C or S
MIQITINSLRTPVXXTPP

SEQ ID NO: 5561 - protein, 10 aa, Artificial Sequence
  GFR-binding peptide
MIQMTINSMK

SEQ ID NO: 5562 - protein, 17 aa, Artificial Sequence
  GFR-binding peptide
  MOD_RES (14)..(15): Xaa is C or S
MIQMTINSMKTPTXXPG

SEQ ID NO: 5563 - protein, 15 aa, Artificial Sequence
  GFR-binding peptide
MIQVTINSHHVRSPQ

SEQ ID NO: 5564 - protein, 13 aa, Artificial Sequence
  GFR-binding peptide
MIQMTINSMKTPT

SEQ ID NO: 5565 - protein, 14 aa, Artificial Sequence
  GFR-binding peptide
  MOD_RES (14)..(14): Xaa is C or S
MIQITINSLDQPVX

SEQ ID NO: 5566 - protein, 14 aa, Artificial Sequence
  GFR-binding peptide
  MOD_RES (14)..(14): Xaa is C or S
MIQMTINSQGTPVX

SEQ ID NO: 5567 - protein, 12 aa, Artificial Sequence
  GFR-binding peptide
MIQMTINSQGTP

SEQ ID NO: 5568 - protein, 12 aa, Artificial Sequence
  GFR-binding peptide
MIQITINSLDQP

SEQ ID NO: 5569 - protein, 16 aa, Artificial Sequence
  GFR-binding peptide
  MOD_RES (14)..(15): Xaa is C or S
MIQVTINSLKTPAXXP

SEQ ID NO: 5570 - protein, 20 aa, Artificial Sequence
  GFR-binding peptide
  MOD_RES (16)..(16): Xaa is C or S
MIQVTINSHHVRSPQXKVSS

SEQ ID NO: 5571 - protein, 12 aa, Artificial Sequence
  GFR-binding peptide
MIQMTINSEETP

SEQ ID NO: 5572 - protein, 15 aa, Artificial Sequence
  GFR-binding peptide
  MOD_RES (14)..(15): Xaa is C or S
MIQVTINSLKTPAXX

SEQ ID NO: 5573 - protein, 11 aa, Artificial Sequence
  GFR-binding peptide
MIQITINSLAQ

SEQ ID NO: 5574 - protein, 19 aa, Artificial Sequence
  GFR-binding peptide
  MOD_RES (14)..(15): Xaa is C or S
MIQMTINSTKVPAXXTSPV

SEQ ID NO: 5575 - protein, 10 aa, Artificial Sequence
  GFR-binding peptide
MIQMTINSTK

SEQ ID NO: 5576 - protein, 13 aa, Artificial Sequence
  GFR-binding peptide
MIQITINSLDQPV

SEQ ID NO: 5577 - protein, 11 aa, Artificial Sequence
  GFR-binding peptide
MIQMTINSTKV

SEQ ID NO: 5578 - protein, 18 aa, Artificial Sequence
  GFR-binding peptide
  MOD_RES (14)..(15): Xaa is C or S
MIQITINSLAQPVXXPAA

SEQ ID NO: 5579 - protein, 17 aa, Artificial Sequence
  GFR-binding peptide
  MOD_RES (14)..(15): Xaa is C or S
MIQITINSLRAPVXXSA

SEQ ID NO: 5580 - protein, 11 aa, Artificial Sequence
  GFR-binding peptide
MIQVTINSHHV

SEQ ID NO: 5581 - protein, 18 aa, Artificial Sequence
  GFR-binding peptide
  MOD_RES (14)..(14): Xaa is C or S
MIQMTINSQGTPVXELGE

SEQ ID NO: 5582 - protein, 13 aa, Artificial Sequence
  GFR-binding peptide
MIQITINSLDQSV

SEQ ID NO: 5583 - protein, 18 aa, Artificial Sequence
  GFR-binding peptide
  MOD_RES (14)..(15): Xaa is C or S
MIQMTINSTKVPAXXTSP

SEQ ID NO: 5584 - protein, 18 aa, Artificial Sequence
  GFR-binding peptide
  MOD_RES (16)..(16): Xaa is C or S
MIQVTINSHHVRSPQXKV

SEQ ID NO: 5585 - protein, 14 aa, Artificial Sequence
  GFR-binding peptide
MIQVTINSLQVQTP

SEQ ID NO: 5586 - protein, 17 aa, Artificial Sequence
  GFR-binding peptide
  MOD_RES (14)..(15): Xaa is C or S
MIQITINSLAQPVXXPA

SEQ ID NO: 5587 - protein, 10 aa, Artificial Sequence
  GFR-binding peptide
MIQVTINSHH

SEQ ID NO: 5588 - protein, 9 aa, Artificial Sequence
  GFR-binding peptide
MIQITINSL

SEQ ID NO: 5589 - protein, 17 aa, Artificial Sequence
  GFR-binding peptide
  MOD_RES (14)..(15): Xaa is C or S
MIQITINSLDQSVXXPS

SEQ ID NO: 5590 - protein, 10 aa, Artificial Sequence
  GFR-binding peptide
MIQMTINSEE

SEQ ID NO: 5591 - protein, 17 aa, Artificial Sequence
  GFR-binding peptide
  MOD_RES (14)..(15): Xaa is C or S
MIQMTINSTKVPAXXTS

SEQ ID NO: 5592 - protein, 18 aa, Artificial Sequence
  GFR-binding peptide
  MOD_RES (14)..(15): Xaa is C or S
MIQITINSLDQSVXXPSA

SEQ ID NO: 5593 - protein, 15 aa, Artificial Sequence
  GFR-binding peptide
  MOD_RES (14)..(15): Xaa is C or S
MIQITINSLAQPVXX

SEQ ID NO: 5594 - protein, 14 aa, Artificial Sequence
  GFR-binding peptide
  MOD_RES (14)..(14): Xaa is C or S
MIQITINSLRTPVX

SEQ ID NO: 5595 - protein, 18 aa, Artificial Sequence
  GFR-binding peptide
  MOD_RES (14)..(15): Xaa is C or S
MIQVTINSLKTPAXXPKP

SEQ ID NO: 5596 - protein, 12 aa, Artificial Sequence
  GFR-binding peptide
MIQITINSLAQP

SEQ ID NO: 5597 - protein, 12 aa, Artificial Sequence
  GFR-binding peptide
MIQVTINSLKTP

SEQ ID NO: 5598 - protein, 18 aa, Artificial Sequence
  GFR-binding peptide
  MOD_RES (14)..(15): Xaa is C or S
MIQITINSLDQPVXXPSA

SEQ ID NO: 5599 - protein, 17 aa, Artificial Sequence
  GFR-binding peptide
  MOD_RES (14)..(14): Xaa is C or S
MIQMTINSQGTPVXELG

SEQ ID NO: 5600 - protein, 12 aa, Artificial Sequence
  GFR-binding peptide
MIQMTINSTKVP

SEQ ID NO: 5601 - protein, 12 aa, Artificial Sequence
  GFR-binding peptide
MIQITINSLRTP

SEQ ID NO: 5602 - protein, 14 aa, Artificial Sequence
  GFR-binding peptide
  MOD_RES (14)..(14): Xaa is C or S
MIQITINSLDQSVX

SEQ ID NO: 5603 - protein, 19 aa, Artificial Sequence
  GFR-binding peptide
  MOD_RES (14)..(15): Xaa is C or S
MIQITINSLRAPVXXSAPA

SEQ ID NO: 5604 - protein, 16 aa, Artificial Sequence
  GFR-binding peptide
  MOD_RES (14)..(14): Xaa is C or S
MIQMTINSQGTPVXEL

SEQ ID NO: 5605 - protein, 17 aa, Artificial Sequence
  GFR-binding peptide
  MOD_RES (16)..(16): Xaa is C or S
MIQVTINSLQVQTPRXQ

SEQ ID NO: 5606 - protein, 13 aa, Artificial Sequence
  GFR-binding peptide
MIQITINSLRAPV

SEQ ID NO: 5607 - protein, 20 aa, Artificial Sequence
  GFR-binding peptide
  MOD_RES (14)..(15): Xaa is C or S
MIQVTINSLKTPAXXPKPVH

SEQ ID NO: 5608 - protein, 17 aa, Artificial Sequence
  GFR-binding peptide
  MOD_RES (14)..(15): Xaa is C or S
MIQITINSLRTPVXXTP

SEQ ID NO: 5609 - protein, 13 aa, Artificial Sequence
  GFR-binding peptide
MIQMTINSEETPV

SEQ ID NO: 5610 - protein, 13 aa, Artificial Sequence
  GFR-binding peptide
MIQMTINSQGTPV

SEQ ID NO: 5611 - protein, 20 aa, Artificial Sequence
  GFR-binding peptide
  MOD_RES (14)..(15): Xaa is C or S
MIQITINSLDQPVXXPSASA

SEQ ID NO: 5612 - protein, 19 aa, Artificial Sequence
  GFR-binding peptide
  MOD_RES (14)..(14): Xaa is C or S
MIQMTINSQGTPVXELGED

SEQ ID NO: 5613 - protein, 9 aa, Artificial Sequence
  GFR-binding peptide
MIQMTINSM

SEQ ID NO: 5614 - protein, 19 aa, Artificial Sequence
  GFR-binding peptide
  MOD_RES (14)..(15): Xaa is C or S
MIQVTINSLKTPAXXPKPV

SEQ ID NO: 5615 - protein, 19 aa, Artificial Sequence
  GFR-binding peptide
  MOD_RES (14)..(15): Xaa is C or S
MIQITINSLAQPVXXPAAS

SEQ ID NO: 5616 - protein, 17 aa, Artificial Sequence
  GFR-binding peptide
  MOD_RES (14)..(15): Xaa is C or S
MIQVTINSLKTPAXXPK

SEQ ID NO: 5617 - protein, 16 aa, Artificial Sequence
  GFR-binding peptide
  MOD_RES (14)..(15): Xaa is C or S
MIQITINSLAQPVXXP

SEQ ID NO: 5618 - protein, 20 aa, Artificial Sequence
  GFR-binding peptide
  MOD_RES (14)..(15): Xaa is C or S
MIQITINSLRTPVXXTPPTS

SEQ ID NO: 5619 - protein, 12 aa, Artificial Sequence
  GFR-binding peptide
MIQMTINSMKTP

SEQ ID NO: 5620 - protein, 10 aa, Artificial Sequence
  GFR-binding peptide
MIQITINSLD

SEQ ID NO: 5621 - protein, 14 aa, Artificial Sequence
  GFR-binding peptide
  MOD_RES (14)..(14): Xaa is C or S
MIQITINSLRAPVX

SEQ ID NO: 5622 - protein, 16 aa, Artificial Sequence
  GFR-binding peptide
  MOD_RES (14)..(15): Xaa is C or S
MIQITINSLDQPVXXP

SEQ ID NO: 5623 - protein, 14 aa, Artificial Sequence
  GFR-binding peptide
  MOD_RES (14)..(14): Xaa is C or S
MIQVTINSLKTPAX

SEQ ID NO: 5624 - protein, 19 aa, Artificial Sequence
  GFR-binding peptide
  MOD_RES (14)..(14): Xaa is C or S
MIQMTINSEETPVXELGED

SEQ ID NO: 5625 - protein, 20 aa, Artificial Sequence
  GFR-binding peptide
  MOD_RES (14)..(15): Xaa is C or S
MIQITINSLDQSVXXPSASA

SEQ ID NO: 5626 - protein, 19 aa, Artificial Sequence
  GFR-binding peptide
  MOD_RES (16)..(16): Xaa is C or S
MIQVTINSHHVRSPQXKVS

SEQ ID NO: 5627 - protein, 18 aa, Artificial Sequence
  GFR-binding peptide
  MOD_RES (14)..(15): Xaa is C or S
MIQITINSLRAPVXXSAP

SEQ ID NO: 5628 - protein, 9 aa, Artificial Sequence
  GFR-binding peptide
MIQVTINSL

SEQ ID NO: 5629 - protein, 19 aa, Artificial Sequence
  GFR-binding peptide
  MOD_RES (14)..(15): Xaa is C or S
MIQMTINSMKTPTXXPGAS

SEQ ID NO: 5630 - protein, 11 aa, Artificial Sequence
  GFR-binding peptide
MIQMTINSMKT

SEQ ID NO: 5631 - protein, 19 aa, Artificial Sequence
  GFR-binding peptide
  MOD_RES (16)..(16): Xaa is C or S
MIQVTINSLQVQTPRXQVN

SEQ ID NO: 5632 - protein, 15 aa, Artificial Sequence
  GFR-binding peptide
  MOD_RES (14)..(15): Xaa is C or S
MIQITINSLDQSVXX

SEQ ID NO: 5633 - protein, 16 aa, Artificial Sequence
  GFR-binding peptide
  MOD_RES (16)..(16): Xaa is C or S
MIQVTINSHHVRSPQX

SEQ ID NO: 5634 - protein, 9 aa, Artificial Sequence
  GFR-binding peptide
MIQVTINSH

SEQ ID NO: 5635 - protein, 15 aa, Artificial Sequence
  GFR-binding peptide
  MOD_RES (14)..(14): Xaa is C or S
MIQMTINSQGTPVXE

SEQ ID NO: 5636 - protein, 8 aa, Artificial Sequence
  GFR-binding peptide
MIQMTINS

SEQ ID NO: 5637 - protein, 17 aa, Artificial Sequence
  GFR-binding peptide
  MOD_RES (14)..(15): Xaa is C or S
MIQITINSLDQPVXXPS

SEQ ID NO: 5638 - protein, 20 aa, Artificial Sequence
  GFR-binding peptide
  MOD_RES (14)..(15): Xaa is C or S
MIQITINSLRAPVXXSAPAA

SEQ ID NO: 5639 - protein, 14 aa, Artificial Sequence
  GFR-binding peptide
  MOD_RES (14)..(14): Xaa is C or S
MIQMTINSTKVPAX

SEQ ID NO: 5640 - protein, 10 aa, Artificial Sequence
  GFR-binding peptide
MIQMTINSQG

SEQ ID NO: 5641 - protein, 11 aa, Artificial Sequence
  GFR-binding peptide
MIQVTINSLKT

SEQ ID NO: 5642 - protein, 9 aa, Artificial Sequence
  GFR-binding peptide
MIQMTINSQ

SEQ ID NO: 5643 - protein, 12 aa, Artificial Sequence
  GFR-binding peptide
MIQVTINSLQVQ

SEQ ID NO: 5644 - protein, 11 aa, Artificial Sequence
  GFR-binding peptide
MIQITINSLRT

SEQ ID NO: 5645 - protein, 10 aa, Artificial Sequence
  GFR-binding peptide
KMNAISILYF

SEQ ID NO: 5646 - protein, 13 aa, Artificial Sequence
  GFR-binding peptide
APTQLSAISVLYL

SEQ ID NO: 5647 - protein, 14 aa, Artificial Sequence
  GFR-binding peptide
  MOD_RES (1)..(1): Xaa is C or S
XVPQALNAISILYF

SEQ ID NO: 5648 - protein, 16 aa, Artificial Sequence
  GFR-binding peptide
  MOD_RES (2)..(3): Xaa is C or S
PXXTPTKMSAISMLYL

SEQ ID NO: 5649 - protein, 13 aa, Artificial Sequence
  GFR-binding peptide
VPTKLSAISILYL

SEQ ID NO: 5650 - protein, 17 aa, Artificial Sequence
  GFR-binding peptide
  MOD_RES (3)..(4): Xaa is C or S
KAXXAPTKLSAISVLYL

SEQ ID NO: 5651 - protein, 14 aa, Artificial Sequence
  GFR-binding peptide
  MOD_RES (1)..(1): Xaa is C or S
XVPTKLNAISILYF

SEQ ID NO: 5652 - protein, 9 aa, Artificial Sequence
  GFR-binding peptide
TNAISMLYF

SEQ ID NO: 5653 - protein, 10 aa, Artificial Sequence
  GFR-binding peptide
QLSAISVLYL

SEQ ID NO: 5654 - protein, 19 aa, Artificial Sequence
  GFR-binding peptide
  MOD_RES (5)..(6): Xaa is C or S
SASPXXVSQDLSAISILYL

SEQ ID NO: 5655 - protein, 20 aa, Artificial Sequence
  GFR-binding peptide
  MOD_RES (6)..(7): Xaa is C or S
GIPEPXXVPEKMNAISILYF

SEQ ID NO: 5656 - protein, 20 aa, Artificial Sequence
  GFR-binding peptide
  MOD_RES (6)..(7): Xaa is C or S
AAPASXXVPARLNAISILYF

SEQ ID NO: 5657 - protein, 15 aa, Artificial Sequence
  GFR-binding peptide
  MOD_RES (1)..(2): Xaa is C or S
XXAPVKTNAISMLYF

SEQ ID NO: 5658 - protein, 11 aa, Artificial Sequence
  GFR-binding peptide
QDLNAISILYF

SEQ ID NO: 5659 - protein, 15 aa, Artificial Sequence
  GFR-binding peptide
  MOD_RES (1)..(2): Xaa is C or S
XXVPARLSAISILYL

SEQ ID NO: 5660 - protein, 13 aa, Artificial Sequence
  GFR-binding peptide
VPTRLSAISILYL

SEQ ID NO: 5661 - protein, 13 aa, Artificial Sequence
  GFR-binding peptide
VPQALSAISILYL

SEQ ID NO: 5662 - protein, 19 aa, Artificial Sequence
  GFR-binding peptide
  MOD_RES (5)..(6): Xaa is C or S
SAAPXXVPQALNAISILYF

SEQ ID NO: 5663 - protein, 10 aa, Artificial Sequence
  GFR-binding peptide
ALSAISILYL

SEQ ID NO: 5664 - protein, 19 aa, Artificial Sequence
  GFR-binding peptide
  MOD_RES (5)..(6): Xaa is C or S
IPEPXXVPEKMSAISILYL

SEQ ID NO: 5665 - protein, 12 aa, Artificial Sequence
  GFR-binding peptide
PTELNAISMLYF

SEQ ID NO: 5666 - protein, 12 aa, Artificial Sequence
  GFR-binding peptide
PARLNAISILYF

SEQ ID NO: 5667 - protein, 10 aa, Artificial Sequence
  GFR-binding peptide
RLSAISILYL

SEQ ID NO: 5668 - protein, 14 aa, Artificial Sequence
  GFR-binding peptide
  MOD_RES (1)..(1): Xaa is C or S
XVPEKMSAISILYL

SEQ ID NO: 5669 - protein, 11 aa, Artificial Sequence
  GFR-binding peptide
TKMNAISMLYF

SEQ ID NO: 5670 - protein, 10 aa, Artificial Sequence
  GFR-binding peptide
ELNAISMLYF

SEQ ID NO: 5671 - protein, 18 aa, Artificial Sequence
  GFR-binding peptide
  MOD_RES (4)..(5): Xaa is C or S
PASXXVPARLSAISILYL

SEQ ID NO: 5672 - protein, 18 aa, Artificial Sequence
  GFR-binding peptide
  MOD_RES (4)..(5): Xaa is C or S
PEPXXVPEKMSAISILYL

SEQ ID NO: 5673 - protein, 18 aa, Artificial Sequence
  GFR-binding peptide
  MOD_RES (4)..(5): Xaa is C or S
AGPXXTPTKMSAISMLYL

SEQ ID NO: 5674 - protein, 20 aa, Artificial Sequence
  GFR-binding peptide
  MOD_RES (6)..(7): Xaa is C or S
STPPTXXVPTRLSAISILYL

SEQ ID NO: 5675 - protein, 12 aa, Artificial Sequence
  GFR-binding peptide
SQDLSAISILYL

SEQ ID NO: 5676 - protein, 14 aa, Artificial Sequence
  GFR-binding peptide
  MOD_RES (1)..(1): Xaa is C or S
XAPVKTSAISMLYL

SEQ ID NO: 5677 - protein, 18 aa, Artificial Sequence
  GFR-binding peptide
  MOD_RES (4)..(5): Xaa is C or S
PKAXXAPTKLNAISVLYF

SEQ ID NO: 5678 - protein, 13 aa, Artificial Sequence
  GFR-binding peptide
VPTKLNAISVLYF

SEQ ID NO: 5679 - protein, 19 aa, Artificial Sequence
  GFR-binding peptide
  MOD_RES (5)..(6): Xaa is C or S
VPKAXXAPTKLNAISVLYF

SEQ ID NO: 5680 - protein, 10 aa, Artificial Sequence
  GFR-binding peptide
KLSAISILYL

SEQ ID NO: 5681 - protein, 12 aa, Artificial Sequence
  GFR-binding peptide
PQDLNAISILYF

SEQ ID NO: 5682 - protein, 11 aa, Artificial Sequence
  GFR-binding peptide
EKMNAISILYF

SEQ ID NO: 5683 - protein, 11 aa, Artificial Sequence
  GFR-binding peptide
TRLSAISILYL

SEQ ID NO: 5684 - protein, 14 aa, Artificial Sequence
  GFR-binding peptide
  MOD_RES (1)..(1): Xaa is C or S
XAPTKLSAISVLYL

SEQ ID NO: 5685 - protein, 9 aa, Artificial Sequence
  GFR-binding peptide
MSAISMLYL

SEQ ID NO: 5686 - protein, 19 aa, Artificial Sequence
  GFR-binding peptide
  MOD_RES (5)..(6): Xaa is C or S
VPKPXXAPTKLSAISVLYL

SEQ ID NO: 5687 - protein, 19 aa, Artificial Sequence
  GFR-binding peptide
  MOD_RES (5)..(6): Xaa is C or S
TPPTXXVPTRLSAISILYL

SEQ ID NO: 5688 - protein, 19 aa, Artificial Sequence
  GFR-binding peptide
  MOD_RES (5)..(6): Xaa is C or S
IPKAXXVPTELNAISMLYF

SEQ ID NO: 5689 - protein, 17 aa, Artificial Sequence
  GFR-binding peptide
  MOD_RES (3)..(4): Xaa is C or S
SPXXVPQDLSAISILYL

SEQ ID NO: 5690 - protein, 16 aa, Artificial Sequence
  GFR-binding peptide
  MOD_RES (2)..(3): Xaa is C or S
SXXVPARLNAISILYF

SEQ ID NO: 5691 - protein, 19 aa, Artificial Sequence
  GFR-binding peptide
  MOD_RES (5)..(6): Xaa is C or S
SASPXXVPQDLNAISILYF

SEQ ID NO: 5692 - protein, 20 aa, Artificial Sequence
  GFR-binding peptide
  MOD_RES (6)..(7): Xaa is C or S
SIPKAXXVPTELNAISMLYF

SEQ ID NO: 5693 - protein, 19 aa, Artificial Sequence
  GFR-binding peptide
  MOD_RES (5)..(6): Xaa is C or S
VGKAXXVPTKLSAISVLYL

SEQ ID NO: 5694 - protein, 16 aa, Artificial Sequence
  GFR-binding peptide
  MOD_RES (2)..(3): Xaa is C or S
PXXVPQALSAISILYL

SEQ ID NO: 5695 - protein, 19 aa, Artificial Sequence
  GFR-binding peptide
  MOD_RES (5)..(6): Xaa is C or S
APASXXVPARLNAISILYF

SEQ ID NO: 5696 - protein, 16 aa, Artificial Sequence
  GFR-binding peptide
  MOD_RES (2)..(3): Xaa is C or S
PXXAPTQLSAISVLYL

SEQ ID NO: 5697 - protein, 16 aa, Artificial Sequence
  GFR-binding peptide
  MOD_RES (2)..(3): Xaa is C or S
AXXVPTELNAISMLYF

SEQ ID NO: 5698 - protein, 11 aa, Artificial Sequence
  GFR-binding peptide
ARLNAISILYF

SEQ ID NO: 5699 - protein, 15 aa, Artificial Sequence
  GFR-binding peptide
  MOD_RES (1)..(2): Xaa is C or S
XXVPQDLSAISILYL

SEQ ID NO: 5700 - protein, 12 aa, Artificial Sequence
  GFR-binding peptide
PEKMSAISILYL

SEQ ID NO: 5701 - protein, 10 aa, Artificial Sequence
  GFR-binding peptide
DLSAISILYL

SEQ ID NO: 5702 - protein, 17 aa, Artificial Sequence
  GFR-binding peptide
  MOD_RES (3)..(4): Xaa is C or S
KAXXVPTKLSAISVLYL

SEQ ID NO: 5703 - protein, 20 aa, Artificial Sequence
  GFR-binding peptide
  MOD_RES (6)..(7): Xaa is C or S
KASKAXXVPTKLNAISILYF

SEQ ID NO: 5704 - protein, 9 aa, Artificial Sequence
  GFR-binding peptide
LNAISMLYF

SEQ ID NO: 5705 - protein, 20 aa, Artificial Sequence
  GFR-binding peptide
  MOD_RES (6)..(7): Xaa is C or S
AVPKAXXAPTKLSAISVLYL

SEQ ID NO: 5706 - protein, 20 aa, Artificial Sequence
  GFR-binding peptide
  MOD_RES (6)..(7): Xaa is C or S
HVPKPXXAPTKLSAISVLYL

SEQ ID NO: 5707 - protein, 13 aa, Artificial Sequence
  GFR-binding peptide
VPARLSAISILYL

SEQ ID NO: 5708 - protein, 15 aa, Artificial Sequence
  GFR-binding peptide
  MOD_RES (1)..(2): Xaa is C or S
XXVPEKMNAISILYF

SEQ ID NO: 5709 - protein, 13 aa, Artificial Sequence
  GFR-binding peptide
VPARLNAISILYF

SEQ ID NO: 5710 - protein, 16 aa, Artificial Sequence
  GFR-binding peptide
  MOD_RES (2)..(3): Xaa is C or S
AXXVPTKLSAISILYL

SEQ ID NO: 5711 - protein, 16 aa, Artificial Sequence
  GFR-binding peptide
  MOD_RES (2)..(3): Xaa is C or S
AXXAPTKLNAISVLYF

SEQ ID NO: 5712 - protein, 16 aa, Artificial Sequence
  GFR-binding peptide
  MOD_RES (2)..(3): Xaa is C or S
AXXVPTKLNAISILYF

SEQ ID NO: 5713 - protein, 12 aa, Artificial Sequence
  GFR-binding peptide
PTRLSAISILYL

SEQ ID NO: 5714 - protein, 17 aa, Artificial Sequence
  GFR-binding peptide
  MOD_RES (3)..(4): Xaa is C or S
APXXVPQALSAISILYL

SEQ ID NO: 5715 - protein, 15 aa, Artificial Sequence
  GFR-binding peptide
  MOD_RES (1)..(2): Xaa is C or S
XXVPTKLSAISVLYL

SEQ ID NO: 5716 - protein, 16 aa, Artificial Sequence
  GFR-binding peptide
  MOD_RES (3)..(3): Xaa is C or S
PTXAPTKLSAISVLYL

SEQ ID NO: 5717 - protein, 20 aa, Artificial Sequence
  GFR-binding peptide
  MOD_RES (6)..(7): Xaa is C or S
GSAGPXXTPTKMNAISMLYF

SEQ ID NO: 5718 - protein, 15 aa, Artificial Sequence
  GFR-binding peptide
  MOD_RES (1)..(2): Xaa is C or S
XXVPEKMSAISILYL

SEQ ID NO: 5719 - protein, 14 aa, Artificial Sequence
  GFR-binding peptide
  MOD_RES (1)..(1): Xaa is C or S
XVSQDLSAISILYL

SEQ ID NO: 5720 - protein, 15 aa, Artificial Sequence
  GFR-binding peptide
  MOD_RES (1)..(2): Xaa is C or S
XXVPTKLNAISVLYF

SEQ ID NO: 5721 - protein, 9 aa, Artificial Sequence
  GFR-binding peptide
LSAISVLYL

SEQ ID NO: 5722 - protein, 13 aa, Artificial Sequence
  GFR-binding peptide
VSQDLSAISILYL

SEQ ID NO: 5723 - protein, 10 aa, Artificial Sequence
  GFR-binding peptide
KTNAISMLYF

SEQ ID NO: 5724 - protein, 11 aa, Artificial Sequence
  GFR-binding peptide
VKTSAISMLYL

SEQ ID NO: 5725 - protein, 11 aa, Artificial Sequence
  GFR-binding peptide
QALSAISILYL

SEQ ID NO: 5726 - protein, 19 aa, Artificial Sequence
  GFR-binding peptide
  MOD_RES (5)..(6): Xaa is C or S
APASXXVPARLSAISILYL

SEQ ID NO: 5727 - protein, 17 aa, Artificial Sequence
  GFR-binding peptide
  MOD_RES (3)..(4): Xaa is C or S
ASXXVPARLNAISILYF

SEQ ID NO: 5728 - protein, 17 aa, Artificial Sequence
  GFR-binding peptide
  MOD_RES (3)..(4): Xaa is C or S
SPXXVPQDLNAISILYF

SEQ ID NO: 5729 - protein, 16 aa, Artificial Sequence
  GFR-binding peptide
  MOD_RES (2)..(3): Xaa is C or S
AXXAPTKLSAISVLYL

SEQ ID NO: 5730 - protein, 16 aa, Artificial Sequence
  GFR-binding peptide
  MOD_RES (2)..(3): Xaa is C or S
PXXVPQDLSAISILYL

SEQ ID NO: 5731 - protein, 9 aa, Artificial Sequence
  GFR-binding peptide
MNAISILYF

SEQ ID NO: 5732 - protein, 18 aa, Artificial Sequence
  GFR-binding peptide
  MOD_RES (4)..(5): Xaa is C or S
ASPXXVPQDLSAISILYL

SEQ ID NO: 5733 - protein, 20 aa, Artificial Sequence
  GFR-binding peptide
  MOD_RES (6)..(7): Xaa is C or S
KVGKAXXVPTKLSAISVLYL

SEQ ID NO: 5734 - protein, 19 aa, Artificial Sequence
  GFR-binding peptide
  MOD_RES (5)..(6): Xaa is C or S
VPSTXXAPVKTSAISMLYL

SEQ ID NO: 5735 - protein, 15 aa, Artificial Sequence
  GFR-binding peptide
  MOD_RES (1)..(2): Xaa is C or S
XXVPQALSAISILYL

SEQ ID NO: 5736 - protein, 20 aa, Artificial Sequence
  GFR-binding peptide
  MOD_RES (6)..(7): Xaa is C or S
ASASPXXVSQDLSAISILYL

SEQ ID NO: 5737 - protein, 18 aa, Artificial Sequence
  GFR-binding peptide
  MOD_RES (4)..(5): Xaa is C or S
GKAXXVPTKLSAISVLYL

SEQ ID NO: 5738 - protein, 13 aa, Artificial Sequence
  GFR-binding peptide
TPTKMNAISMLYF

SEQ ID NO: 5739 - protein, 20 aa, Artificial Sequence
  GFR-binding peptide
  MOD_RES (6)..(7): Xaa is C or S
RVPSTXXAPVKTNAISMLYF

SEQ ID NO: 5740 - protein, 19 aa, Artificial Sequence
  GFR-binding peptide
  MOD_RES (5)..(6): Xaa is C or S
ASKAXXVPTKLNAISILYF

SEQ ID NO: 5741 - protein, 18 aa, Artificial Sequence
  GFR-binding peptide
  MOD_RES (4)..(5): Xaa is C or S
AAPXXVPQALNAISILYF

SEQ ID NO: 5742 - protein, 13 aa, Artificial Sequence
  GFR-binding peptide
TPTKMSAISMLYL

SEQ ID NO: 5743 - protein, 18 aa, Artificial Sequence
  GFR-binding peptide
  MOD_RES (4)..(5): Xaa is C or S
PASXXVPARLNAISILYF

SEQ ID NO: 5744 - protein, 17 aa, Artificial Sequence
  GFR-binding peptide
  MOD_RES (3)..(4): Xaa is C or S
GPXXTPTKMSAISMLYL

SEQ ID NO: 5745 - protein, 15 aa, Artificial Sequence
  GFR-binding peptide
  MOD_RES (1)..(2): Xaa is C or S
XXVSQDLNAISILYF

SEQ ID NO: 5746 - protein, 14 aa, Artificial Sequence
  GFR-binding peptide
  MOD_RES (1)..(1): Xaa is C or S
XVPTRLNAISILYF

SEQ ID NO: 5747 - protein, 12 aa, Artificial Sequence
  GFR-binding peptide
PTKLNAISILYF

SEQ ID NO: 5748 - protein, 12 aa, Artificial Sequence
  GFR-binding peptide
PTKLSAISILYL

SEQ ID NO: 5749 - protein, 14 aa, Artificial Sequence
  GFR-binding peptide
  MOD_RES (1)..(1): Xaa is C or S
XAPVKTNAISMLYF

SEQ ID NO: 5750 - protein, 18 aa, Artificial Sequence
  GFR-binding peptide
  MOD_RES (4)..(5): Xaa is C or S
PKAXXVPTELNAISMLYF

SEQ ID NO: 5751 - protein, 14 aa, Artificial Sequence
  GFR-binding peptide
  MOD_RES (1)..(1): Xaa is C or S
XVPTRLSAISILYL

SEQ ID NO: 5752 - protein, 13 aa, Artificial Sequence
  GFR-binding peptide
VPTKLSAISVLYL

SEQ ID NO: 5753 - protein, 16 aa, Artificial Sequence
  GFR-binding peptide
  MOD_RES (2)..(3): Xaa is C or S
PXXAPTKLSAISVLYL

SEQ ID NO: 5754 - protein, 13 aa, Artificial Sequence
  GFR-binding peptide
VPEKMSAISILYL

SEQ ID NO: 5755 - protein, 11 aa, Artificial Sequence
  GFR-binding peptide
QALNAISILYF

SEQ ID NO: 5756 - protein, 20 aa, Artificial Sequence
  GFR-binding peptide
  MOD_RES (6)..(7): Xaa is C or S
ASASPXXVSQDLNAISILYF

SEQ ID NO: 5757 - protein, 19 aa, Artificial Sequence
  GFR-binding peptide
  MOD_RES (5)..(6): Xaa is C or S
VPSTXXAPVKTNAISMLYF

SEQ ID NO: 5758 - protein, 10 aa, Artificial Sequence
  GFR-binding peptide
KTSAISMLYL

SEQ ID NO: 5759 - protein, 13 aa, Artificial Sequence
  GFR-binding peptide
VPEKMNAISILYF

SEQ ID NO: 5760 - protein, 15 aa, Artificial Sequence
  GFR-binding peptide
  MOD_RES (1)..(2): Xaa is C or S
XXTPTKMSAISMLYL

SEQ ID NO: 5761 - protein, 18 aa, Artificial Sequence
  GFR-binding peptide
  MOD_RES (4)..(5): Xaa is C or S
GKAXXVPTKLNAISVLYF

SEQ ID NO: 5762 - protein, 15 aa, Artificial Sequence
  GFR-binding peptide
  MOD_RES (1)..(2): Xaa is C or S
XXVPARLNAISILYF

SEQ ID NO: 5763 - protein, 11 aa, Artificial Sequence
  GFR-binding peptide
TQLSAISVLYL

SEQ ID NO: 5764 - protein, 9 aa, Artificial Sequence
  GFR-binding peptide
MSAISILYL

SEQ ID NO: 5765 - protein, 13 aa, Artificial Sequence
  GFR-binding peptide
VSQDLNAISILYF

SEQ ID NO: 5766 - protein, 14 aa, Artificial Sequence
  GFR-binding peptide
  MOD_RES (1)..(1): Xaa is C or S
XAPTQLSAISVLYL

SEQ ID NO: 5767 - protein, 11 aa, Artificial Sequence
  GFR-binding peptide
QDLSAISILYL

SEQ ID NO: 5768 - protein, 11 aa, Artificial Sequence
  GFR-binding peptide
VKTNAISMLYF

SEQ ID NO: 5769 - protein, 17 aa, Artificial Sequence
  GFR-binding peptide
  MOD_RES (3)..(4): Xaa is C or S
KAXXVPTELNAISMLYF

SEQ ID NO: 5770 - protein, 12 aa, Artificial Sequence
  GFR-binding peptide
PTRLNAISILYF

SEQ ID NO: 5771 - protein, 14 aa, Artificial Sequence
  GFR-binding peptide
  MOD_RES (1)..(1): Xaa is C or S
XVPTKLSAISILYL

SEQ ID NO: 5772 - protein, 17 aa, Artificial Sequence
  GFR-binding peptide
  MOD_RES (3)..(4): Xaa is C or S
APXXVPQALNAISILYF

SEQ ID NO: 5773 - protein, 18 aa, Artificial Sequence
  GFR-binding peptide
  MOD_RES (4)..(5): Xaa is C or S
ASPXXVPQDLNAISILYF

SEQ ID NO: 5774 - protein, 20 aa, Artificial Sequence
  GFR-binding peptide
  MOD_RES (6)..(7): Xaa is C or S
TVPKPXXAPTQLSAISVLYL

SEQ ID NO: 5775 - protein, 18 aa, Artificial Sequence
  GFR-binding peptide
  MOD_RES (4)..(5): Xaa is C or S
AAPXXVPQALSAISILYL

SEQ ID NO: 5776 - protein, 19 aa, Artificial Sequence
  GFR-binding peptide
  MOD_RES (5)..(6): Xaa is C or S
VPKPXXAPTQLSAISVLYL

SEQ ID NO: 5777 - protein, 11 aa, Artificial Sequence
  GFR-binding peptide
TELNAISMLYF

SEQ ID NO: 5778 - protein, 16 aa, Artificial Sequence
  GFR-binding peptide
  MOD_RES (2)..(3): Xaa is C or S
PXXVPQDLNAISILYF

SEQ ID NO: 5779 - protein, 14 aa, Artificial Sequence
  GFR-binding peptide
  MOD_RES (1)..(1): Xaa is C or S
XVPQALSAISILYL

SEQ ID NO: 5780 - protein, 20 aa, Artificial Sequence
  GFR-binding peptide
  MOD_RES (7)..(7): Xaa is C or S
HVTKPTXAPTKLSAISVLYL

SEQ ID NO: 5781 - protein, 18 aa, Artificial Sequence
  GFR-binding peptide
  MOD_RES (4)..(5): Xaa is C or S
PPTXXVPTRLNAISILYF

SEQ ID NO: 5782 - protein, 16 aa, Artificial Sequence
  GFR-binding peptide
  MOD_RES (2)..(3): Xaa is C or S
PXXTPTKMNAISMLYF

SEQ ID NO: 5783 - protein, 10 aa, Artificial Sequence
  GFR-binding peptide
KMSAISILYL

SEQ ID NO: 5784 - protein, 19 aa, Artificial Sequence
  GFR-binding peptide
  MOD_RES (5)..(6): Xaa is C or S
IPEPXXVPEKMNAISILYF

SEQ ID NO: 5785 - protein, 20 aa, Artificial Sequence
  GFR-binding peptide
  MOD_RES (6)..(7): Xaa is C or S
GIPEPXXVPEKMSAISILYL

SEQ ID NO: 5786 - protein, 9 aa, Artificial Sequence
  GFR-binding peptide
TSAISMLYL

SEQ ID NO: 5787 - protein, 13 aa, Artificial Sequence
  GFR-binding peptide
APTKLSAISVLYL

SEQ ID NO: 5788 - protein, 11 aa, Artificial Sequence
  GFR-binding peptide
ARLSAISILYL

SEQ ID NO: 5789 - protein, 20 aa, Artificial Sequence
  GFR-binding peptide
  MOD_RES (6)..(7): Xaa is C or S
AAPASXXVPARLSAISILYL

SEQ ID NO: 5790 - protein, 17 aa, Artificial Sequence
  GFR-binding peptide
  MOD_RES (3)..(4): Xaa is C or S
KAXXAPTKLNAISVLYF

SEQ ID NO: 5791 - protein, 19 aa, Artificial Sequence
  GFR-binding peptide
  MOD_RES (5)..(6): Xaa is C or S
SASPXXVSQDLNAISILYF

SEQ ID NO: 5792 - protein, 19 aa, Artificial Sequence
  GFR-binding peptide
  MOD_RES (5)..(6): Xaa is C or S
VPKAXXAPTKLSAISVLYL

SEQ ID NO: 5793 - protein, 16 aa, Artificial Sequence
  GFR-binding peptide
  MOD_RES (2)..(3): Xaa is C or S
SXXVPARLSAISILYL

SEQ ID NO: 5794 - protein, 17 aa, Artificial Sequence
  GFR-binding peptide
  MOD_RES (3)..(4): Xaa is C or S
KAXXVPTKLSAISILYL

SEQ ID NO: 5795 - protein, 14 aa, Artificial Sequence
  GFR-binding peptide
  MOD_RES (1)..(1): Xaa is C or S
XTPTKMSAISMLYL

SEQ ID NO: 5796 - protein, 20 aa, Artificial Sequence
  GFR-binding peptide
  MOD_RES (6)..(7): Xaa is C or S
YVPKPXXAPTKLSAISVLYL

SEQ ID NO: 5797 - protein, 16 aa, Artificial Sequence
  GFR-binding peptide
  MOD_RES (2)..(3): Xaa is C or S
PXXVPQALNAISILYF

SEQ ID NO: 5798 - protein, 10 aa, Artificial Sequence
  GFR-binding peptide
KLSAISVLYL

SEQ ID NO: 5799 - protein, 12 aa, Artificial Sequence
  GFR-binding peptide
PTKMSAISMLYL

SEQ ID NO: 5800 - protein, 19 aa, Artificial Sequence
  GFR-binding peptide
  MOD_RES (5)..(6): Xaa is C or S
SASPXXVPQDLSAISILYL

SEQ ID NO: 5801 - protein, 17 aa, Artificial Sequence
  GFR-binding peptide
  MOD_RES (3)..(4): Xaa is C or S
KAXXVPTKLNAISVLYF

SEQ ID NO: 5802 - protein, 9 aa, Artificial Sequence
  GFR-binding peptide
MNAISMLYF

SEQ ID NO: 5803 - protein, 14 aa, Artificial Sequence
  GFR-binding peptide
  MOD_RES (1)..(1): Xaa is C or S
XVPEKMNAISILYF

SEQ ID NO: 5804 - protein, 17 aa, Artificial Sequence
  GFR-binding peptide
  MOD_RES (3)..(4): Xaa is C or S
PTXXVPTRLSAISILYL

SEQ ID NO: 5805 - protein, 19 aa, Artificial Sequence
  GFR-binding peptide
  MOD_RES (5)..(6): Xaa is C or S
TPPTXXVPTRLNAISILYF

SEQ ID NO: 5806 - protein, 15 aa, Artificial Sequence
  GFR-binding peptide
  MOD_RES (1)..(2): Xaa is C or S
XXTPTKMNAISMLYF

SEQ ID NO: 5807 - protein, 15 aa, Artificial Sequence
  GFR-binding peptide
  MOD_RES (1)..(2): Xaa is C or S
XXVSQDLSAISILYL

SEQ ID NO: 5808 - protein, 20 aa, Artificial Sequence
  GFR-binding peptide
  MOD_RES (6)..(7): Xaa is C or S
KASKAXXVPTKLSAISILYL

SEQ ID NO: 5809 - protein, 11 aa, Artificial Sequence
  GFR-binding peptide
TKMSAISMLYL

SEQ ID NO: 5810 - protein, 10 aa, Artificial Sequence
  GFR-binding peptide
KLNAISILYF

SEQ ID NO: 5811 - protein, 17 aa, Artificial Sequence
  GFR-binding peptide
  MOD_RES (4)..(4): Xaa is C or S
KPTXAPTKLSAISVLYL

SEQ ID NO: 5812 - protein, 15 aa, Artificial Sequence
  GFR-binding peptide
  MOD_RES (1)..(2): Xaa is C or S
XXVPQDLNAISILYF

SEQ ID NO: 5813 - protein, 18 aa, Artificial Sequence
  GFR-binding peptide
  MOD_RES (4)..(5): Xaa is C or S
PEPXXVPEKMNAISILYF

SEQ ID NO: 5814 - protein, 17 aa, Artificial Sequence
  GFR-binding peptide
  MOD_RES (3)..(4): Xaa is C or S
GPXXTPTKMNAISMLYF

SEQ ID NO: 5815 - protein, 16 aa, Artificial Sequence
  GFR-binding peptide
  MOD_RES (2)..(3): Xaa is C or S
TXXVPTRLNAISILYF

SEQ ID NO: 5816 - protein, 20 aa, Artificial Sequence
  GFR-binding peptide
  MOD_RES (6)..(7): Xaa is C or S
STPPTXXVPTRLNAISILYF

SEQ ID NO: 5817 - protein, 11 aa, Artificial Sequence
  GFR-binding peptide
TKLSAISVLYL

SEQ ID NO: 5818 - protein, 20 aa, Artificial Sequence
  GFR-binding peptide
  MOD_RES (6)..(7): Xaa is C or S
KIPKAXXVPTELNAISMLYF

SEQ ID NO: 5819 - protein, 17 aa, Artificial Sequence
  GFR-binding peptide
  MOD_RES (3)..(4): Xaa is C or S
ASXXVPARLSAISILYL

SEQ ID NO: 5820 - protein, 13 aa, Artificial Sequence
  GFR-binding peptide
VPTRLNAISILYF

SEQ ID NO: 5821 - protein, 10 aa, Artificial Sequence
  GFR-binding peptide
RLNAISILYF

SEQ ID NO: 5822 - protein, 17 aa, Artificial Sequence
  GFR-binding peptide
  MOD_RES (3)..(4): Xaa is C or S
KPXXAPTKLSAISVLYL

SEQ ID NO: 5823 - protein, 18 aa, Artificial Sequence
  GFR-binding peptide
  MOD_RES (4)..(5): Xaa is C or S
PKAXXAPTKLSAISVLYL

SEQ ID NO: 5824 - protein, 12 aa, Artificial Sequence
  GFR-binding peptide
SQDLNAISILYF

SEQ ID NO: 5825 - protein, 19 aa, Artificial Sequence
  GFR-binding peptide
  MOD_RES (5)..(6): Xaa is C or S
SAAPXXVPQALSAISILYL

SEQ ID NO: 5826 - protein, 15 aa, Artificial Sequence
  GFR-binding peptide
  MOD_RES (1)..(2): Xaa is C or S
XXVPTELNAISMLYF

SEQ ID NO: 5827 - protein, 12 aa, Artificial Sequence
  GFR-binding peptide
PARLSAISILYL

SEQ ID NO: 5828 - protein, 20 aa, Artificial Sequence
  GFR-binding peptide
  MOD_RES (6)..(7): Xaa is C or S
ASASPXXVPQDLSAISILYL

SEQ ID NO: 5829 - protein, 10 aa, Artificial Sequence
  GFR-binding peptide
ALNAISILYF

SEQ ID NO: 5830 - protein, 13 aa, Artificial Sequence
  GFR-binding peptide
VPTKLNAISILYF

SEQ ID NO: 5831 - protein, 19 aa, Artificial Sequence
  GFR-binding peptide
  MOD_RES (5)..(6): Xaa is C or S
ASKAXXVPTKLSAISILYL

SEQ ID NO: 5832 - protein, 14 aa, Artificial Sequence
  GFR-binding peptide
  MOD_RES (1)..(1): Xaa is C or S
XVPARLSAISILYL

SEQ ID NO: 5833 - protein, 18 aa, Artificial Sequence
  GFR-binding peptide
  MOD_RES (4)..(5): Xaa is C or S
AGPXXTPTKMNAISMLYF

SEQ ID NO: 5834 - protein, 15 aa, Artificial Sequence
  GFR-binding peptide
  MOD_RES (1)..(2): Xaa is C or S
XXVPTKLNAISILYF

SEQ ID NO: 5835 - protein, 15 aa, Artificial Sequence
  GFR-binding peptide
  MOD_RES (1)..(2): Xaa is C or S
XXVPQALNAISILYF

SEQ ID NO: 5836 - protein, 15 aa, Artificial Sequence
  GFR-binding peptide
  MOD_RES (2)..(2): Xaa is C or S
TXAPTKLSAISVLYL

SEQ ID NO: 5837 - protein, 13 aa, Artificial Sequence
  GFR-binding peptide
VPQDLSAISILYL

SEQ ID NO: 5838 - protein, 13 aa, Artificial Sequence
  GFR-binding peptide
VPQALNAISILYF

SEQ ID NO: 5839 - protein, 19 aa, Artificial Sequence
  GFR-binding peptide
  MOD_RES (5)..(6): Xaa is C or S
SAGPXXTPTKMSAISMLYL

SEQ ID NO: 5840 - protein, 12 aa, Artificial Sequence
  GFR-binding peptide
PTKLSAISVLYL

SEQ ID NO: 5841 - protein, 15 aa, Artificial Sequence
  GFR-binding peptide
  MOD_RES (1)..(2): Xaa is C or S
XXVPTRLSAISILYL

SEQ ID NO: 5842 - protein, 14 aa, Artificial Sequence
  GFR-binding peptide
  MOD_RES (1)..(1): Xaa is C or S
XVPQDLSAISILYL

SEQ ID NO: 5843 - protein, 13 aa, Artificial Sequence
  GFR-binding peptide
VPTELNAISMLYF

SEQ ID NO: 5844 - protein, 19 aa, Artificial Sequence
  GFR-binding peptide
  MOD_RES (5)..(6): Xaa is C or S
SAGPXXTPTKMNAISMLYF

SEQ ID NO: 5845 - protein, 18 aa, Artificial Sequence
  GFR-binding peptide
  MOD_RES (4)..(5): Xaa is C or S
PKPXXAPTKLSAISVLYL

SEQ ID NO: 5846 - protein, 16 aa, Artificial Sequence
  GFR-binding peptide
  MOD_RES (2)..(3): Xaa is C or S
PXXVPEKMSAISILYL

SEQ ID NO: 5847 - protein, 14 aa, Artificial Sequence
  GFR-binding peptide
  MOD_RES (1)..(1): Xaa is C or S
XVSQDLNAISILYF

SEQ ID NO: 5848 - protein, 18 aa, Artificial Sequence
  GFR-binding peptide
  MOD_RES (4)..(5): Xaa is C or S
SKAXXVPTKLNAISILYF

SEQ ID NO: 5849 - protein, 16 aa, Artificial Sequence
  GFR-binding peptide
  MOD_RES (2)..(3): Xaa is C or S
PXXVPEKMNAISILYF

SEQ ID NO: 5850 - protein, 10 aa, Artificial Sequence
  GFR-binding peptide
KMNAISMLYF

SEQ ID NO: 5851 - protein, 10 aa, Artificial Sequence
  GFR-binding peptide
KMSAISMLYL

SEQ ID NO: 5852 - protein, 14 aa, Artificial Sequence
  GFR-binding peptide
  MOD_RES (1)..(1): Xaa is C or S
XVPQDLNAISILYF

SEQ ID NO: 5853 - protein, 15 aa, Artificial Sequence
  GFR-binding peptide
  MOD_RES (1)..(2): Xaa is C or S
XXVPTRLNAISILYF

SEQ ID NO: 5854 - protein, 13 aa, Artificial Sequence
  GFR-binding peptide
VPQDLNAISILYF

SEQ ID NO: 5855 - protein, 11 aa, Artificial Sequence
  GFR-binding peptide
TRLNAISILYF

SEQ ID NO: 5856 - protein, 15 aa, Artificial Sequence
  GFR-binding peptide
  MOD_RES (1)..(2): Xaa is C or S
XXVPTKLSAISILYL

SEQ ID NO: 5857 - protein, 16 aa, Artificial Sequence
  GFR-binding peptide
  MOD_RES (2)..(3): Xaa is C or S
PXXVSQDLNAISILYF

SEQ ID NO: 5858 - protein, 19 aa, Artificial Sequence
  GFR-binding peptide
  MOD_RES (5)..(6): Xaa is C or S
VGKAXXVPTKLNAISVLYF

SEQ ID NO: 5859 - protein, 15 aa, Artificial Sequence
  GFR-binding peptide
  MOD_RES (1)..(2): Xaa is C or S
XXAPTKLSAISVLYL

SEQ ID NO: 5860 - protein, 11 aa, Artificial Sequence
  GFR-binding peptide
EKMSAISILYL

SEQ ID NO: 5861 - protein, 14 aa, Artificial Sequence
  GFR-binding peptide
  MOD_RES (1)..(1): Xaa is C or S
XVPARLNAISILYF

SEQ ID NO: 5862 - protein, 17 aa, Artificial Sequence
  GFR-binding peptide
  MOD_RES (3)..(4): Xaa is C or S
EPXXVPEKMNAISILYF

SEQ ID NO: 5863 - protein, 12 aa, Artificial Sequence
  GFR-binding peptide
PEKMNAISILYF

SEQ ID NO: 5864 - protein, 14 aa, Artificial Sequence
  GFR-binding peptide
  MOD_RES (1)..(1): Xaa is C or S
XVPTELNAISMLYF

SEQ ID NO: 5865 - protein, 16 aa, Artificial Sequence
  GFR-binding peptide
  MOD_RES (2)..(3): Xaa is C or S
AXXVPTKLNAISVLYF

SEQ ID NO: 5866 - protein, 17 aa, Artificial Sequence
  GFR-binding peptide
  MOD_RES (3)..(4): Xaa is C or S
SPXXVSQDLSAISILYL

SEQ ID NO: 5867 - protein, 9 aa, Artificial Sequence
  GFR-binding peptide
LSAISILYL

SEQ ID NO: 5868 - protein, 17 aa, Artificial Sequence
  GFR-binding peptide
  MOD_RES (3)..(4): Xaa is C or S
STXXAPVKTSAISMLYL

SEQ ID NO: 5869 - protein, 20 aa, Artificial Sequence
  GFR-binding peptide
  MOD_RES (6)..(7): Xaa is C or S
ASASPXXVPQDLNAISILYF

SEQ ID NO: 5870 - protein, 10 aa, Artificial Sequence
  GFR-binding peptide
DLNAISILYF

SEQ ID NO: 5871 - protein, 18 aa, Artificial Sequence
  GFR-binding peptide
  MOD_RES (4)..(5): Xaa is C or S
PKPXXAPTQLSAISVLYL

SEQ ID NO: 5872 - protein, 18 aa, Artificial Sequence
  GFR-binding peptide
  MOD_RES (4)..(5): Xaa is C or S
PSTXXAPVKTNAISMLYF

SEQ ID NO: 5873 - protein, 15 aa, Artificial Sequence
  GFR-binding peptide
  MOD_RES (1)..(2): Xaa is C or S
XXAPTQLSAISVLYL

SEQ ID NO: 5874 - protein, 12 aa, Artificial Sequence
  GFR-binding peptide
PTQLSAISVLYL

SEQ ID NO: 5875 - protein, 11 aa, Artificial Sequence
  GFR-binding peptide
TKLSAISILYL

SEQ ID NO: 5876 - protein, 20 aa, Artificial Sequence
  GFR-binding peptide
  MOD_RES (6)..(7): Xaa is C or S
ASAAPXXVPQALNAISILYF

SEQ ID NO: 5877 - protein, 19 aa, Artificial Sequence
  GFR-binding peptide
  MOD_RES (6)..(6): Xaa is C or S
VTKPTXAPTKLSAISVLYL

SEQ ID NO: 5878 - protein, 20 aa, Artificial Sequence
  GFR-binding peptide
  MOD_RES (6)..(7): Xaa is C or S
ASAAPXXVPQALSAISILYL

SEQ ID NO: 5879 - protein, 14 aa, Artificial Sequence
  GFR-binding peptide
  MOD_RES (1)..(1): Xaa is C or S
XVPTKLNAISVLYF

SEQ ID NO: 5880 - protein, 18 aa, Artificial Sequence
  GFR-binding peptide
  MOD_RES (4)..(5): Xaa is C or S
ASPXXVSQDLNAISILYF

SEQ ID NO: 5881 - protein, 16 aa, Artificial Sequence
  GFR-binding peptide
  MOD_RES (2)..(3): Xaa is C or S
TXXVPTRLSAISILYL

SEQ ID NO: 5882 - protein, 16 aa, Artificial Sequence
  GFR-binding peptide
  MOD_RES (2)..(3): Xaa is C or S
TXXAPVKTNAISMLYF

SEQ ID NO: 5883 - protein, 13 aa, Artificial Sequence
  GFR-binding peptide
APVKTSAISMLYL

SEQ ID NO: 5884 - protein, 12 aa, Artificial Sequence
  GFR-binding peptide
PQALSAISILYL

SEQ ID NO: 5885 - protein, 14 aa, Artificial Sequence
  GFR-binding peptide
  MOD_RES (1)..(1): Xaa is C or S
XVPTKLSAISVLYL

SEQ ID NO: 5886 - protein, 16 aa, Artificial Sequence
  GFR-binding peptide
  MOD_RES (2)..(3): Xaa is C or S
AXXVPTKLSAISVLYL

SEQ ID NO: 5887 - protein, 12 aa, Artificial Sequence
  GFR-binding peptide
PVKTNAISMLYF

SEQ ID NO: 5888 - protein, 13 aa, Artificial Sequence
  GFR-binding peptide
APVKTNAISMLYF

SEQ ID NO: 5889 - protein, 14 aa, Artificial Sequence
  GFR-binding peptide
  MOD_RES (1)..(1): Xaa is C or S
XTPTKMNAISMLYF

SEQ ID NO: 5890 - protein, 12 aa, Artificial Sequence
  GFR-binding peptide
PQALNAISILYF

SEQ ID NO: 5891 - protein, 12 aa, Artificial Sequence
  GFR-binding peptide
PVKTSAISMLYL

SEQ ID NO: 5892 - protein, 12 aa, Artificial Sequence
  GFR-binding peptide
PQDLSAISILYL

SEQ ID NO: 5893 - protein, 17 aa, Artificial Sequence
  GFR-binding peptide
  MOD_RES (3)..(4): Xaa is C or S
KAXXVPTKLNAISILYF

SEQ ID NO: 5894 - protein, 18 aa, Artificial Sequence
  GFR-binding peptide
  MOD_RES (4)..(5): Xaa is C or S
PSTXXAPVKTSAISMLYL

SEQ ID NO: 5895 - protein, 17 aa, Artificial Sequence
  GFR-binding peptide
  MOD_RES (3)..(4): Xaa is C or S
PTXXVPTRLNAISILYF

SEQ ID NO: 5896 - protein, 16 aa, Artificial Sequence
  GFR-binding peptide
  MOD_RES (2)..(3): Xaa is C or S
PXXVSQDLSAISILYL

SEQ ID NO: 5897 - protein, 17 aa, Artificial Sequence
  GFR-binding peptide
  MOD_RES (3)..(4): Xaa is C or S
EPXXVPEKMSAISILYL

SEQ ID NO: 5898 - protein, 15 aa, Artificial Sequence
  GFR-binding peptide
  MOD_RES (1)..(2): Xaa is C or S
XXAPVKTSAISMLYL

SEQ ID NO: 5899 - protein, 18 aa, Artificial Sequence
  GFR-binding peptide
  MOD_RES (4)..(5): Xaa is C or S
SKAXXVPTKLSAISILYL

SEQ ID NO: 5900 - protein, 12 aa, Artificial Sequence
  GFR-binding peptide
PTKMNAISMLYF

SEQ ID NO: 5901 - protein, 18 aa, Artificial Sequence
  GFR-binding peptide
  MOD_RES (5)..(5): Xaa is C or S
TKPTXAPTKLSAISVLYL

SEQ ID NO: 5902 - protein, 11 aa, Artificial Sequence
  GFR-binding peptide
TKLNAISILYF

SEQ ID NO: 5903 - protein, 16 aa, Artificial Sequence
  GFR-binding peptide
  MOD_RES (2)..(3): Xaa is C or S
TXXAPVKTSAISMLYL

SEQ ID NO: 5904 - protein, 18 aa, Artificial Sequence
  GFR-binding peptide
  MOD_RES (4)..(5): Xaa is C or S
PPTXXVPTRLSAISILYL

SEQ ID NO: 5905 - protein, 17 aa, Artificial Sequence
  GFR-binding peptide
  MOD_RES (3)..(4): Xaa is C or S
SPXXVSQDLNAISILYF

SEQ ID NO: 5906 - protein, 18 aa, Artificial Sequence
  GFR-binding peptide
  MOD_RES (4)..(5): Xaa is C or S
ASPXXVSQDLSAISILYL

SEQ ID NO: 5907 - protein, 17 aa, Artificial Sequence
  GFR-binding peptide
  MOD_RES (3)..(4): Xaa is C or S
KPXXAPTQLSAISVLYL

SEQ ID NO: 5908 - protein, 17 aa, Artificial Sequence
  GFR-binding peptide
  MOD_RES (3)..(4): Xaa is C or S
STXXAPVKTNAISMLYF

SEQ ID NO: 5909 - protein, 9 aa, Artificial Sequence
  GFR-binding peptide
LNAISILYF

SEQ ID NO: 5910 - protein, 10 aa, Artificial Sequence
  GFR-binding peptide
FYLISIANMK

SEQ ID NO: 5911 - protein, 13 aa, Artificial Sequence
  GFR-binding peptide
FYLVSIANLKTPA

SEQ ID NO: 5912 - protein, 13 aa, Artificial Sequence
  GFR-binding peptide
LYLVSIASLQTPA

SEQ ID NO: 5913 - protein, 14 aa, Artificial Sequence
  GFR-binding peptide
  MOD_RES (14)..(14): Xaa is C or S
FYLISIANLAQPVX

SEQ ID NO: 5914 - protein, 16 aa, Artificial Sequence
  GFR-binding peptide
  MOD_RES (14)..(15): Xaa is C or S
LYLMSIASMKTPTXXP

SEQ ID NO: 5915 - protein, 13 aa, Artificial Sequence
  GFR-binding peptide
LYLISIASLKTPV

SEQ ID NO: 5916 - protein, 17 aa, Artificial Sequence
  GFR-binding peptide
  MOD_RES (14)..(15): Xaa is C or S
LYLVSIASLKTPAXXAK

SEQ ID NO: 5917 - protein, 14 aa, Artificial Sequence
  GFR-binding peptide
  MOD_RES (14)..(14): Xaa is C or S
FYLISIANLKTPVX

SEQ ID NO: 5918 - protein, 9 aa, Artificial Sequence
  GFR-binding peptide
FYLMSIANT

SEQ ID NO: 5919 - protein, 10 aa, Artificial Sequence
  GFR-binding peptide
LYLVSIASLQ

SEQ ID NO: 5920 - protein, 19 aa, Artificial Sequence
  GFR-binding peptide
  MOD_RES (14)..(15): Xaa is C or S
LYLISIASLDQSVXXPSAS

SEQ ID NO: 5921 - protein, 20 aa, Artificial Sequence
  GFR-binding peptide
  MOD_RES (14)..(15): Xaa is C or S
FYLISIANMKEPVXXPEPIG

SEQ ID NO: 5922 - protein, 20 aa, Artificial Sequence
  GFR-binding peptide
  MOD_RES (14)..(15): Xaa is C or S
FYLISIANLRAPVXXSAPAA

SEQ ID NO: 5923 - protein, 14 aa, Artificial Sequence
  GFR-binding peptide
  MOD_RES (14)..(14): Xaa is C or S
FYLVSIANLQTPAX

SEQ ID NO: 5924 - protein, 15 aa, Artificial Sequence
  GFR-binding peptide
  MOD_RES (14)..(15): Xaa is C or S
FYLMSIANTKVPAXX

SEQ ID NO: 5925 - protein, 11 aa, Artificial Sequence
  GFR-binding peptide
FYLISIANLDQ

SEQ ID NO: 5926 - protein, 15 aa, Artificial Sequence
  GFR-binding peptide
  MOD_RES (14)..(15): Xaa is C or S
LYLISIASLRAPVXX

SEQ ID NO: 5927 - protein, 13 aa, Artificial Sequence
  GFR-binding peptide
LYLISIASLRTPV

SEQ ID NO: 5928 - protein, 15 aa, Artificial Sequence
  GFR-binding peptide
  MOD_RES (14)..(15): Xaa is C or S
LYLMSIASLETPVXX

SEQ ID NO: 5929 - protein, 13 aa, Artificial Sequence
  GFR-binding peptide
LYLISIASLAQPV

SEQ ID NO: 5930 - protein, 19 aa, Artificial Sequence
  GFR-binding peptide
  MOD_RES (14)..(15): Xaa is C or S
FYLISIANLAQPVXXPAAS

SEQ ID NO: 5931 - protein, 10 aa, Artificial Sequence
  GFR-binding peptide
LYLISIASLA

SEQ ID NO: 5932 - protein, 19 aa, Artificial Sequence
  GFR-binding peptide
  MOD_RES (14)..(15): Xaa is C or S
LYLISIASMKEPVXXPEPI

SEQ ID NO: 5933 - protein, 12 aa, Artificial Sequence
  GFR-binding peptide
FYLMSIANLETP

SEQ ID NO: 5934 - protein, 15 aa, Artificial Sequence
  GFR-binding peptide
  MOD_RES (14)..(14): Xaa is C or S
FYLVSIANLKTPAXT

SEQ ID NO: 5935 - protein, 12 aa, Artificial Sequence
  GFR-binding peptide
FYLISIANLRAP

SEQ ID NO: 5936 - protein, 20 aa, Artificial Sequence
  GFR-binding peptide
  MOD_RES (14)..(14): Xaa is C or S
FYLVSIANLKTPAXTPKTVH

SEQ ID NO: 5937 - protein, 10 aa, Artificial Sequence
  GFR-binding peptide
LYLISIASLR

SEQ ID NO: 5938 - protein, 14 aa, Artificial Sequence
  GFR-binding peptide
  MOD_RES (14)..(14): Xaa is C or S
LYLISIASMKEPVX

SEQ ID NO: 5939 - protein, 11 aa, Artificial Sequence
  GFR-binding peptide
FYLMSIANMKT

SEQ ID NO: 5940 - protein, 10 aa, Artificial Sequence
  GFR-binding peptide
FYLMSIANLE

SEQ ID NO: 5941 - protein, 18 aa, Artificial Sequence
  GFR-binding peptide
  MOD_RES (14)..(15): Xaa is C or S
LYLISIASLRAPVXXSAP

SEQ ID NO: 5942 - protein, 18 aa, Artificial Sequence
  GFR-binding peptide
  MOD_RES (14)..(15): Xaa is C or S
LYLISIASMKEPVXXPEP

SEQ ID NO: 5943 - protein, 18 aa, Artificial Sequence
  GFR-binding peptide
  MOD_RES (14)..(15): Xaa is C or S
LYLMSIASMKTPTXXPGA

SEQ ID NO: 5944 - protein, 20 aa, Artificial Sequence
  GFR-binding peptide
  MOD_RES (14)..(15): Xaa is C or S
LYLISIASLRTPVXXTPPTS

SEQ ID NO: 5945 - protein, 16 aa, Artificial Sequence
  GFR-binding peptide
  MOD_RES (14)..(15): Xaa is C or S
FYLVSIANLKTPAXXP

SEQ ID NO: 5946 - protein, 12 aa, Artificial Sequence
  GFR-binding peptide
LYLISIASLDQS

SEQ ID NO: 5947 - protein, 14 aa, Artificial Sequence
  GFR-binding peptide
  MOD_RES (14)..(14): Xaa is C or S
LYLMSIASTKVPAX

SEQ ID NO: 5948 - protein, 18 aa, Artificial Sequence
  GFR-binding peptide
  MOD_RES (14)..(15): Xaa is C or S
FYLVSIANLKTPAXXAKP

SEQ ID NO: 5949 - protein, 13 aa, Artificial Sequence
  GFR-binding peptide
FYLVSIANLKTPV

SEQ ID NO: 5950 - protein, 19 aa, Artificial Sequence
  GFR-binding peptide
  MOD_RES (14)..(15): Xaa is C or S
FYLVSIANLKTPAXXAKPV

SEQ ID NO: 5951 - protein, 10 aa, Artificial Sequence
  GFR-binding peptide
LYLISIASLK

SEQ ID NO: 5952 - protein, 12 aa, Artificial Sequence
  GFR-binding peptide
FYLISIANLDQP

SEQ ID NO: 5953 - protein, 11 aa, Artificial Sequence
  GFR-binding peptide
FYLISIANMKE

SEQ ID NO: 5954 - protein, 11 aa, Artificial Sequence
  GFR-binding peptide
LYLISIASLRT

SEQ ID NO: 5955 - protein, 14 aa, Artificial Sequence
  GFR-binding peptide
  MOD_RES (14)..(14): Xaa is C or S
LYLVSIASLKTPAX

SEQ ID NO: 5956 - protein, 9 aa, Artificial Sequence
  GFR-binding peptide
LYLMSIASM

SEQ ID NO: 5957 - protein, 19 aa, Artificial Sequence
  GFR-binding peptide
  MOD_RES (14)..(15): Xaa is C or S
LYLVSIASLKTPAXXPKPV

SEQ ID NO: 5958 - protein, 19 aa, Artificial Sequence
  GFR-binding peptide
  MOD_RES (14)..(15): Xaa is C or S
LYLISIASLRTPVXXTPPT

SEQ ID NO: 5959 - protein, 19 aa, Artificial Sequence
  GFR-binding peptide
  MOD_RES (14)..(15): Xaa is C or S
FYLMSIANLETPVXXAKPI

SEQ ID NO: 5960 - protein, 17 aa, Artificial Sequence
  GFR-binding peptide
  MOD_RES (14)..(15): Xaa is C or S
LYLISIASLDQPVXXPS

SEQ ID NO: 5961 - protein, 16 aa, Artificial Sequence
  GFR-binding peptide
  MOD_RES (14)..(15): Xaa is C or S
FYLISIANLRAPVXXS

SEQ ID NO: 5962 - protein, 19 aa, Artificial Sequence
  GFR-binding peptide
  MOD_RES (14)..(15): Xaa is C or S
FYLISIANLDQPVXXPSAS

SEQ ID NO: 5963 - protein, 20 aa, Artificial Sequence
  GFR-binding peptide
  MOD_RES (14)..(15): Xaa is C or S
FYLMSIANLETPVXXAKPIS

SEQ ID NO: 5964 - protein, 19 aa, Artificial Sequence
  GFR-binding peptide
  MOD_RES (14)..(15): Xaa is C or S
LYLVSIASLKTPVXXAKGV

SEQ ID NO: 5965 - protein, 10 aa, Artificial Sequence
  GFR-binding peptide
FYLVSIANLK

SEQ ID NO: 5966 - protein, 16 aa, Artificial Sequence
  GFR-binding peptide
  MOD_RES (14)..(15): Xaa is C or S
LYLISIASLAQPVXXP

SEQ ID NO: 5967 - protein, 19 aa, Artificial Sequence
  GFR-binding peptide
  MOD_RES (14)..(15): Xaa is C or S
FYLISIANLRAPVXXSAPA

SEQ ID NO: 5968 - protein, 16 aa, Artificial Sequence
  GFR-binding peptide
  MOD_RES (14)..(15): Xaa is C or S
LYLVSIASLQTPAXXP

SEQ ID NO: 5969 - protein, 16 aa, Artificial Sequence
  GFR-binding peptide
  MOD_RES (14)..(15): Xaa is C or S
FYLMSIANLETPVXXA

SEQ ID NO: 5970 - protein, 11 aa, Artificial Sequence
  GFR-binding peptide
FYLISIANLRA

SEQ ID NO: 5971 - protein, 18 aa, Artificial Sequence
  GFR-binding peptide
  MOD_RES (14)..(15): Xaa is C or S
FYLVSIANLQTPAXXPKP

SEQ ID NO: 5972 - protein, 15 aa, Artificial Sequence
  GFR-binding peptide
  MOD_RES (14)..(15): Xaa is C or S
LYLISIASLDQPVXX

SEQ ID NO: 5973 - protein, 12 aa, Artificial Sequence
  GFR-binding peptide
LYLISIASMKEP

SEQ ID NO: 5974 - protein, 10 aa, Artificial Sequence
  GFR-binding peptide
LYLISIASLD

SEQ ID NO: 5975 - protein, 17 aa, Artificial Sequence
  GFR-binding peptide
  MOD_RES (14)..(15): Xaa is C or S
LYLVSIASLKTPVXXAK

SEQ ID NO: 5976 - protein, 20 aa, Artificial Sequence
  GFR-binding peptide
  MOD_RES (14)..(15): Xaa is C or S
FYLISIANLKTPVXXAKSAK

SEQ ID NO: 5977 - protein, 9 aa, Artificial Sequence
  GFR-binding peptide
FYLMSIANL

SEQ ID NO: 5978 - protein, 20 aa, Artificial Sequence
  GFR-binding peptide
  MOD_RES (14)..(15): Xaa is C or S
LYLVSIASLKTPAXXAKPVA

SEQ ID NO: 5979 - protein, 9 aa, Artificial Sequence
  GFR-binding peptide
FYLVSIANL

SEQ ID NO: 5980 - protein, 20 aa, Artificial Sequence
  GFR-binding peptide
  MOD_RES (14)..(15): Xaa is C or S
LYLVSIASLKTPAXXPKPVH

SEQ ID NO: 5981 - protein, 13 aa, Artificial Sequence
  GFR-binding peptide
LYLISIASLRAPV

SEQ ID NO: 5982 - protein, 15 aa, Artificial Sequence
  GFR-binding peptide
  MOD_RES (14)..(15): Xaa is C or S
FYLISIANMKEPVXX

SEQ ID NO: 5983 - protein, 13 aa, Artificial Sequence
  GFR-binding peptide
LYLMSIASLETPV

SEQ ID NO: 5984 - protein, 13 aa, Artificial Sequence
  GFR-binding peptide
FYLISIANLRAPV

SEQ ID NO: 5985 - protein, 16 aa, Artificial Sequence
  GFR-binding peptide
  MOD_RES (14)..(15): Xaa is C or S
LYLISIASLKTPVXXA

SEQ ID NO: 5986 - protein, 20 aa, Artificial Sequence
  GFR-binding peptide
  MOD_RES (14)..(15): Xaa is C or S
FYLVSIANLKTPAXXPKPVH

SEQ ID NO: 5987 - protein, 16 aa, Artificial Sequence
  GFR-binding peptide
  MOD_RES (14)..(15): Xaa is C or S
FYLVSIANLKTPAXXA

SEQ ID NO: 5988 - protein, 16 aa, Artificial Sequence
  GFR-binding peptide
  MOD_RES (14)..(15): Xaa is C or S
FYLISIANLKTPVXXA

SEQ ID NO: 5989 - protein, 12 aa, Artificial Sequence
  GFR-binding peptide
LYLISIASLRTP

SEQ ID NO: 5990 - protein, 17 aa, Artificial Sequence
  GFR-binding peptide
  MOD_RES (14)..(15): Xaa is C or S
LYLISIASLAQPVXXPA

SEQ ID NO: 5991 - protein, 15 aa, Artificial Sequence
  GFR-binding peptide
  MOD_RES (14)..(15): Xaa is C or S
LYLVSIASLKTPVXX

SEQ ID NO: 5992 - protein, 16 aa, Artificial Sequence
  GFR-binding peptide
  MOD_RES (14)..(14): Xaa is C or S
LYLVSIASLKTPAXTP

SEQ ID NO: 5993 - protein, 20 aa, Artificial Sequence
  GFR-binding peptide
  MOD_RES (14)..(15): Xaa is C or S
FYLMSIANMKTPTXXPGASG

SEQ ID NO: 5994 - protein, 15 aa, Artificial Sequence
  GFR-binding peptide
  MOD_RES (14)..(15): Xaa is C or S
LYLISIASMKEPVXX

SEQ ID NO: 5995 - protein, 14 aa, Artificial Sequence
  GFR-binding peptide
  MOD_RES (14)..(14): Xaa is C or S
LYLISIASLDQSVX

SEQ ID NO: 5996 - protein, 15 aa, Artificial Sequence
  GFR-binding peptide
  MOD_RES (14)..(15): Xaa is C or S
FYLVSIANLKTPVXX

SEQ ID NO: 5997 - protein, 9 aa, Artificial Sequence
  GFR-binding peptide
LYLVSIASL

SEQ ID NO: 5998 - protein, 16 aa, Artificial Sequence
  GFR-binding peptide
  MOD_RES (14)..(14): Xaa is C or S
FYLVSIANLKTPAXTP

SEQ ID NO: 5999 - protein, 13 aa, Artificial Sequence
  GFR-binding peptide
LYLISIASLDQSV

SEQ ID NO: 6000 - protein, 10 aa, Artificial Sequence
  GFR-binding peptide
FYLMSIANTK

SEQ ID NO: 6001 - protein, 11 aa, Artificial Sequence
  GFR-binding peptide
LYLMSIASTKV

SEQ ID NO: 6002 - protein, 11 aa, Artificial Sequence
  GFR-binding peptide
LYLISIASLAQ

SEQ ID NO: 6003 - protein, 19 aa, Artificial Sequence
  GFR-binding peptide
  MOD_RES (14)..(15): Xaa is C or S
LYLISIASLRAPVXXSAPA

SEQ ID NO: 6004 - protein, 11 aa, Artificial Sequence
  GFR-binding peptide
FYLVSIANLKT

SEQ ID NO: 6005 - protein, 19 aa, Artificial Sequence
  GFR-binding peptide
  MOD_RES (14)..(15): Xaa is C or S
FYLVSIANLQTPAXXPKPV

SEQ ID NO: 6006 - protein, 17 aa, Artificial Sequence
  GFR-binding peptide
  MOD_RES (14)..(15): Xaa is C or S
FYLISIANLRAPVXXSA

SEQ ID NO: 6007 - protein, 17 aa, Artificial Sequence
  GFR-binding peptide
  MOD_RES (14)..(15): Xaa is C or S
FYLISIANLDQPVXXPS

SEQ ID NO: 6008 - protein, 16 aa, Artificial Sequence
  GFR-binding peptide
  MOD_RES (14)..(15): Xaa is C or S
LYLVSIASLKTPAXXA

SEQ ID NO: 6009 - protein, 17 aa, Artificial Sequence
  GFR-binding peptide
  MOD_RES (14)..(15): Xaa is C or S
LYLMSIASLETPVXXAK

SEQ ID NO: 6010 - protein, 16 aa, Artificial Sequence
  GFR-binding peptide
  MOD_RES (14)..(15): Xaa is C or S
LYLISIASLDQPVXXP

SEQ ID NO: 6011 - protein, 9 aa, Artificial Sequence
  GFR-binding peptide
FYLISIANM

SEQ ID NO: 6012 - protein, 18 aa, Artificial Sequence
  GFR-binding peptide
  MOD_RES (14)..(15): Xaa is C or S
LYLISIASLDQPVXXPSA

SEQ ID NO: 6013 - protein, 20 aa, Artificial Sequence
  GFR-binding peptide
  MOD_RES (14)..(15): Xaa is C or S
LYLVSIASLKTPVXXAKGVK

SEQ ID NO: 6014 - protein, 19 aa, Artificial Sequence
  GFR-binding peptide
  MOD_RES (14)..(15): Xaa is C or S
LYLMSIASTKVPAXXTSPV

SEQ ID NO: 6015 - protein, 15 aa, Artificial Sequence
  GFR-binding peptide
  MOD_RES (14)..(15): Xaa is C or S
LYLISIASLAQPVXX

SEQ ID NO: 6016 - protein, 11 aa, Artificial Sequence
  GFR-binding peptide
FYLVSIANLQT

SEQ ID NO: 6017 - protein, 20 aa, Artificial Sequence
  GFR-binding peptide
  MOD_RES (14)..(15): Xaa is C or S
LYLISIASLDQSVXXPSASA

SEQ ID NO: 6018 - protein, 18 aa, Artificial Sequence
  GFR-binding peptide
  MOD_RES (14)..(15): Xaa is C or S
LYLVSIASLKTPVXXAKG

SEQ ID NO: 6019 - protein, 13 aa, Artificial Sequence
  GFR-binding peptide
FYLMSIANMKTPT

SEQ ID NO: 6020 - protein, 20 aa, Artificial Sequence
  GFR-binding peptide
  MOD_RES (14)..(15): Xaa is C or S
FYLMSIANTKVPAXXTSPVR

SEQ ID NO: 6021 - protein, 19 aa, Artificial Sequence
  GFR-binding peptide
  MOD_RES (14)..(15): Xaa is C or S
FYLVSIANLKTPAXXPKPV

SEQ ID NO: 6022 - protein, 20 aa, Artificial Sequence
  GFR-binding peptide
  MOD_RES (14)..(15): Xaa is C or S
FYLVSIANLQTPAXXPKPVT

SEQ ID NO: 6023 - protein, 19 aa, Artificial Sequence
  GFR-binding peptide
  MOD_RES (14)..(15): Xaa is C or S
FYLISIANLKTPVXXAKSA

SEQ ID NO: 6024 - protein, 18 aa, Artificial Sequence
  GFR-binding peptide
  MOD_RES (14)..(15): Xaa is C or S
FYLISIANLAQPVXXPAA

SEQ ID NO: 6025 - protein, 13 aa, Artificial Sequence
  GFR-binding peptide
LYLMSIASMKTPT

SEQ ID NO: 6026 - protein, 18 aa, Artificial Sequence
  GFR-binding peptide
  MOD_RES (14)..(15): Xaa is C or S
FYLISIANLRAPVXXSAP

SEQ ID NO: 6027 - protein, 17 aa, Artificial Sequence
  GFR-binding peptide
  MOD_RES (14)..(15): Xaa is C or S
LYLMSIASMKTPTXXPG

SEQ ID NO: 6028 - protein, 15 aa, Artificial Sequence
  GFR-binding peptide
  MOD_RES (14)..(15): Xaa is C or S
FYLISIANLDQSVXX

SEQ ID NO: 6029 - protein, 14 aa, Artificial Sequence
  GFR-binding peptide
  MOD_RES (14)..(14): Xaa is C or S
FYLISIANLRTPVX

SEQ ID NO: 6030 - protein, 12 aa, Artificial Sequence
  GFR-binding peptide
FYLISIANLKTP

SEQ ID NO: 6031 - protein, 12 aa, Artificial Sequence
  GFR-binding peptide
LYLISIASLKTP

SEQ ID NO: 6032 - protein, 14 aa, Artificial Sequence
  GFR-binding peptide
  MOD_RES (14)..(14): Xaa is C or S
FYLMSIANTKVPAX

SEQ ID NO: 6033 - protein, 18 aa, Artificial Sequence
  GFR-binding peptide
  MOD_RES (14)..(15): Xaa is C or S
FYLMSIANLETPVXXAKP

SEQ ID NO: 6034 - protein, 17 aa, Artificial Sequence
  GFR-binding peptide
  MOD_RES (14)..(14): Xaa is C or S
FYLVSIANLKTPAXTPK

SEQ ID NO: 6035 - protein, 14 aa, Artificial Sequence
  GFR-binding peptide
  MOD_RES (14)..(14): Xaa is C or S
LYLISIASLRTPVX

SEQ ID NO: 6036 - protein, 13 aa, Artificial Sequence
  GFR-binding peptide
LYLVSIASLKTPV

SEQ ID NO: 6037 - protein, 16 aa, Artificial Sequence
  GFR-binding peptide
  MOD_RES (14)..(15): Xaa is C or S
LYLVSIASLKTPAXXP

SEQ ID NO: 6038 - protein, 13 aa, Artificial Sequence
  GFR-binding peptide
LYLISIASMKEPV

SEQ ID NO: 6039 - protein, 11 aa, Artificial Sequence
  GFR-binding peptide
FYLISIANLAQ

SEQ ID NO: 6040 - protein, 20 aa, Artificial Sequence
  GFR-binding peptide
  MOD_RES (14)..(15): Xaa is C or S
FYLISIANLDQSVXXPSASA

SEQ ID NO: 6041 - protein, 19 aa, Artificial Sequence
  GFR-binding peptide
  MOD_RES (14)..(15): Xaa is C or S
FYLMSIANTKVPAXXTSPV

SEQ ID NO: 6042 - protein, 10 aa, Artificial Sequence
  GFR-binding peptide
LYLMSIASTK

SEQ ID NO: 6043 - protein, 13 aa, Artificial Sequence
  GFR-binding peptide
FYLISIANMKEPV

SEQ ID NO: 6044 - protein, 15 aa, Artificial Sequence
  GFR-binding peptide
  MOD_RES (14)..(15): Xaa is C or S
LYLMSIASMKTPTXX

SEQ ID NO: 6045 - protein, 18 aa, Artificial Sequence
  GFR-binding peptide
  MOD_RES (14)..(15): Xaa is C or S
FYLVSIANLKTPVXXAKG

SEQ ID NO: 6046 - protein, 15 aa, Artificial Sequence
  GFR-binding peptide
  MOD_RES (14)..(15): Xaa is C or S
FYLISIANLRAPVXX

SEQ ID NO: 6047 - protein, 11 aa, Artificial Sequence
  GFR-binding peptide
LYLVSIASLQT

SEQ ID NO: 6048 - protein, 9 aa, Artificial Sequence
  GFR-binding peptide
LYLISIASM

SEQ ID NO: 6049 - protein, 13 aa, Artificial Sequence
  GFR-binding peptide
FYLISIANLDQSV

SEQ ID NO: 6050 - protein, 14 aa, Artificial Sequence
  GFR-binding peptide
  MOD_RES (14)..(14): Xaa is C or S
LYLVSIASLQTPAX

SEQ ID NO: 6051 - protein, 11 aa, Artificial Sequence
  GFR-binding peptide
LYLISIASLDQ

SEQ ID NO: 6052 - protein, 11 aa, Artificial Sequence
  GFR-binding peptide
FYLMSIANTKV

SEQ ID NO: 6053 - protein, 17 aa, Artificial Sequence
  GFR-binding peptide
  MOD_RES (14)..(15): Xaa is C or S
FYLMSIANLETPVXXAK

SEQ ID NO: 6054 - protein, 12 aa, Artificial Sequence
  GFR-binding peptide
FYLISIANLRTP

SEQ ID NO: 6055 - protein, 14 aa, Artificial Sequence
  GFR-binding peptide
  MOD_RES (14)..(14): Xaa is C or S
LYLISIASLKTPVX

SEQ ID NO: 6056 - protein, 17 aa, Artificial Sequence
  GFR-binding peptide
  MOD_RES (14)..(15): Xaa is C or S
FYLISIANLAQPVXXPA

SEQ ID NO: 6057 - protein, 18 aa, Artificial Sequence
  GFR-binding peptide
  MOD_RES (14)..(15): Xaa is C or S
FYLISIANLDQPVXXPSA

SEQ ID NO: 6058 - protein, 20 aa, Artificial Sequence
  GFR-binding peptide
  MOD_RES (14)..(15): Xaa is C or S
LYLVSIASLQTPAXXPKPVT

SEQ ID NO: 6059 - protein, 18 aa, Artificial Sequence
  GFR-binding peptide
  MOD_RES (14)..(15): Xaa is C or S
LYLMSIASLETPVXXAKP

SEQ ID NO: 6060 - protein, 18 aa, Artificial Sequence
  GFR-binding peptide
  MOD_RES (14)..(15): Xaa is C or S
LYLISIASLAQPVXXPAA

SEQ ID NO: 6061 - protein, 19 aa, Artificial Sequence
  GFR-binding peptide
  MOD_RES (14)..(15): Xaa is C or S
LYLVSIASLQTPAXXPKPV

SEQ ID NO: 6062 - protein, 11 aa, Artificial Sequence
  GFR-binding peptide
FYLMSIANLET

SEQ ID NO: 6063 - protein, 16 aa, Artificial Sequence
  GFR-binding peptide
  MOD_RES (14)..(15): Xaa is C or S
FYLISIANLDQPVXXP

SEQ ID NO: 6064 - protein, 14 aa, Artificial Sequence
  GFR-binding peptide
  MOD_RES (14)..(14): Xaa is C or S
LYLISIASLAQPVX

SEQ ID NO: 6065 - protein, 11 aa, Artificial Sequence
  GFR-binding peptide
LYLMSIASLET

SEQ ID NO: 6066 - protein, 20 aa, Artificial Sequence
  GFR-binding peptide
  MOD_RES (14)..(14): Xaa is C or S
LYLVSIASLKTPAXTPKTVH

SEQ ID NO: 6067 - protein, 18 aa, Artificial Sequence
  GFR-binding peptide
  MOD_RES (14)..(15): Xaa is C or S
FYLISIANLRTPVXXTPP

SEQ ID NO: 6068 - protein, 16 aa, Artificial Sequence
  GFR-binding peptide
  MOD_RES (14)..(15): Xaa is C or S
FYLMSIANMKTPTXXP

SEQ ID NO: 6069 - protein, 10 aa, Artificial Sequence
  GFR-binding peptide
LYLISIASMK

SEQ ID NO: 6070 - protein, 19 aa, Artificial Sequence
  GFR-binding peptide
  MOD_RES (14)..(15): Xaa is C or S
FYLISIANMKEPVXXPEPI

SEQ ID NO: 6071 - protein, 20 aa, Artificial Sequence
  GFR-binding peptide
  MOD_RES (14)..(15): Xaa is C or S
LYLISIASMKEPVXXPEPIG

SEQ ID NO: 6072 - protein, 9 aa, Artificial Sequence
  GFR-binding peptide
LYLMSIAST

SEQ ID NO: 6073 - protein, 13 aa, Artificial Sequence
  GFR-binding peptide
LYLVSIASLKTPA

SEQ ID NO: 6074 - protein, 11 aa, Artificial Sequence
  GFR-binding peptide
LYLISIASLRA

SEQ ID NO: 6075 - protein, 10 aa, Artificial Sequence
  GFR-binding peptide
FYLVSIANLQ

SEQ ID NO: 6076 - protein, 20 aa, Artificial Sequence
  GFR-binding peptide
  MOD_RES (14)..(15): Xaa is C or S
LYLISIASLRAPVXXSAPAA

SEQ ID NO: 6077 - protein, 17 aa, Artificial Sequence
  GFR-binding peptide
  MOD_RES (14)..(15): Xaa is C or S
FYLVSIANLKTPAXXAK

SEQ ID NO: 6078 - protein, 19 aa, Artificial Sequence
  GFR-binding peptide
  MOD_RES (14)..(15): Xaa is C or S
FYLISIANLDQSVXXPSAS

SEQ ID NO: 6079 - protein, 19 aa, Artificial Sequence
  GFR-binding peptide
  MOD_RES (14)..(15): Xaa is C or S
LYLVSIASLKTPAXXAKPV

SEQ ID NO: 6080 - protein, 16 aa, Artificial Sequence
  GFR-binding peptide
  MOD_RES (14)..(15): Xaa is C or S
LYLISIASLRAPVXXS

SEQ ID NO: 6081 - protein, 14 aa, Artificial Sequence
  GFR-binding peptide
  MOD_RES (14)..(14): Xaa is C or S
FYLVSIANLKTPAX

SEQ ID NO: 6082 - protein, 17 aa, Artificial Sequence
  GFR-binding peptide
  MOD_RES (14)..(15): Xaa is C or S
LYLISIASLKTPVXXAK

SEQ ID NO: 6083 - protein, 14 aa, Artificial Sequence
  GFR-binding peptide
  MOD_RES (14)..(14): Xaa is C or S
LYLMSIASMKTPTX

SEQ ID NO: 6084 - protein, 20 aa, Artificial Sequence
  GFR-binding peptide
  MOD_RES (14)..(15): Xaa is C or S
LYLVSIASLKTPAXXPKPVY

SEQ ID NO: 6085 - protein, 16 aa, Artificial Sequence
  GFR-binding peptide
  MOD_RES (14)..(15): Xaa is C or S
FYLISIANLAQPVXXP

SEQ ID NO: 6086 - protein, 10 aa, Artificial Sequence
  GFR-binding peptide
LYLVSIASLK

SEQ ID NO: 6087 - protein, 12 aa, Artificial Sequence
  GFR-binding peptide
LYLMSIASMKTP

SEQ ID NO: 6088 - protein, 20 aa, Artificial Sequence
  GFR-binding peptide
  MOD_RES (14)..(15): Xaa is C or S
LYLMSIASLETPVXXAKPIS

SEQ ID NO: 6089 - protein, 19 aa, Artificial Sequence
  GFR-binding peptide
  MOD_RES (14)..(15): Xaa is C or S
LYLISIASLDQPVXXPSAS

SEQ ID NO: 6090 - protein, 9 aa, Artificial Sequence
  GFR-binding peptide
LYLMSIASL

SEQ ID NO: 6091 - protein, 17 aa, Artificial Sequence
  GFR-binding peptide
  MOD_RES (14)..(15): Xaa is C or S
FYLVSIANLKTPVXXAK

SEQ ID NO: 6092 - protein, 9 aa, Artificial Sequence
  GFR-binding peptide
FYLMSIANM

SEQ ID NO: 6093 - protein, 14 aa, Artificial Sequence
  GFR-binding peptide
  MOD_RES (14)..(14): Xaa is C or S
FYLISIANMKEPVX

SEQ ID NO: 6094 - protein, 17 aa, Artificial Sequence
  GFR-binding peptide
  MOD_RES (14)..(15): Xaa is C or S
LYLISIASLRTPVXXTP

SEQ ID NO: 6095 - protein, 19 aa, Artificial Sequence
  GFR-binding peptide
  MOD_RES (14)..(15): Xaa is C or S
FYLISIANLRTPVXXTPPT

SEQ ID NO: 6096 - protein, 16 aa, Artificial Sequence
  GFR-binding peptide
  MOD_RES (14)..(15): Xaa is C or S
LYLMSIASLETPVXXA

SEQ ID NO: 6097 - protein, 15 aa, Artificial Sequence
  GFR-binding peptide
  MOD_RES (14)..(15): Xaa is C or S
FYLMSIANMKTPTXX

SEQ ID NO: 6098 - protein, 15 aa, Artificial Sequence
  GFR-binding peptide
  MOD_RES (14)..(15): Xaa is C or S
LYLISIASLDQSVXX

SEQ ID NO: 6099 - protein, 20 aa, Artificial Sequence
  GFR-binding peptide
  MOD_RES (14)..(15): Xaa is C or S
LYLISIASLKTPVXXAKSAK

SEQ ID NO: 6100 - protein, 11 aa, Artificial Sequence
  GFR-binding peptide
LYLMSIASMKT

SEQ ID NO: 6101 - protein, 10 aa, Artificial Sequence
  GFR-binding peptide
FYLISIANLK

SEQ ID NO: 6102 - protein, 19 aa, Artificial Sequence
  GFR-binding peptide
  MOD_RES (14)..(14): Xaa is C or S
FYLVSIANLKTPAXTPKTV

SEQ ID NO: 6103 - protein, 17 aa, Artificial Sequence
  GFR-binding peptide
  MOD_RES (14)..(14): Xaa is C or S
LYLVSIASLKTPAXTPK

SEQ ID NO: 6104 - protein, 15 aa, Artificial Sequence
  GFR-binding peptide
  MOD_RES (14)..(15): Xaa is C or S
FYLISIANLDQPVXX

SEQ ID NO: 6105 - protein, 10 aa, Artificial Sequence
  GFR-binding peptide
LYLMSIASLE

SEQ ID NO: 6106 - protein, 18 aa, Artificial Sequence
  GFR-binding peptide
  MOD_RES (14)..(15): Xaa is C or S
FYLISIANMKEPVXXPEP

SEQ ID NO: 6107 - protein, 17 aa, Artificial Sequence
  GFR-binding peptide
  MOD_RES (14)..(15): Xaa is C or S
FYLMSIANMKTPTXXPG

SEQ ID NO: 6108 - protein, 8 aa, Artificial Sequence
  GFR-binding peptide
LYLMSIAS

SEQ ID NO: 6109 - protein, 16 aa, Artificial Sequence
  GFR-binding peptide
  MOD_RES (14)..(15): Xaa is C or S
FYLISIANLRTPVXXT

SEQ ID NO: 6110 - protein, 20 aa, Artificial Sequence
  GFR-binding peptide
  MOD_RES (14)..(15): Xaa is C or S
FYLISIANLRTPVXXTPPTS

SEQ ID NO: 6111 - protein, 11 aa, Artificial Sequence
  GFR-binding peptide
LYLVSIASLKT

SEQ ID NO: 6112 - protein, 20 aa, Artificial Sequence
  GFR-binding peptide
  MOD_RES (14)..(15): Xaa is C or S
FYLMSIANLETPVXXAKPIK

SEQ ID NO: 6113 - protein, 19 aa, Artificial Sequence
  GFR-binding peptide
  MOD_RES (14)..(15): Xaa is C or S
LYLMSIASLETPVXXAKPI

SEQ ID NO: 6114 - protein, 17 aa, Artificial Sequence
  GFR-binding peptide
  MOD_RES (14)..(15): Xaa is C or S
LYLISIASLRAPVXXSA

SEQ ID NO: 6115 - protein, 13 aa, Artificial Sequence
  GFR-binding peptide
FYLISIANLRTPV

SEQ ID NO: 6116 - protein, 15 aa, Artificial Sequence
  GFR-binding peptide
  MOD_RES (14)..(15): Xaa is C or S
FYLVSIANLQTPAXX

SEQ ID NO: 6117 - protein, 10 aa, Artificial Sequence
  GFR-binding peptide
FYLISIANLR

SEQ ID NO: 6118 - protein, 17 aa, Artificial Sequence
  GFR-binding peptide
  MOD_RES (14)..(15): Xaa is C or S
LYLVSIASLKTPAXXPK

SEQ ID NO: 6119 - protein, 18 aa, Artificial Sequence
  GFR-binding peptide
  MOD_RES (14)..(15): Xaa is C or S
LYLVSIASLKTPAXXAKP

SEQ ID NO: 6120 - protein, 12 aa, Artificial Sequence
  GFR-binding peptide
FYLISIANLDQS

SEQ ID NO: 6121 - protein, 19 aa, Artificial Sequence
  GFR-binding peptide
  MOD_RES (14)..(15): Xaa is C or S
LYLISIASLAQPVXXPAAS

SEQ ID NO: 6122 - protein, 15 aa, Artificial Sequence
  GFR-binding peptide
  MOD_RES (14)..(15): Xaa is C or S
FYLMSIANLETPVXX

SEQ ID NO: 6123 - protein, 12 aa, Artificial Sequence
  GFR-binding peptide
LYLISIASLRAP

SEQ ID NO: 6124 - protein, 20 aa, Artificial Sequence
  GFR-binding peptide
  MOD_RES (14)..(15): Xaa is C or S
LYLISIASLDQPVXXPSASA

SEQ ID NO: 6125 - protein, 10 aa, Artificial Sequence
  GFR-binding peptide
FYLISIANLA

SEQ ID NO: 6126 - protein, 13 aa, Artificial Sequence
  GFR-binding peptide
FYLISIANLKTPV

SEQ ID NO: 6127 - protein, 19 aa, Artificial Sequence
  GFR-binding peptide
  MOD_RES (14)..(15): Xaa is C or S
LYLISIASLKTPVXXAKSA

SEQ ID NO: 6128 - protein, 14 aa, Artificial Sequence
  GFR-binding peptide
  MOD_RES (14)..(14): Xaa is C or S
LYLISIASLRAPVX

SEQ ID NO: 6129 - protein, 18 aa, Artificial Sequence
  GFR-binding peptide
  MOD_RES (14)..(15): Xaa is C or S
FYLMSIANMKTPTXXPGA

SEQ ID NO: 6130 - protein, 15 aa, Artificial Sequence
  GFR-binding peptide
  MOD_RES (14)..(15): Xaa is C or S
FYLISIANLKTPVXX

SEQ ID NO: 6131 - protein, 15 aa, Artificial Sequence
  GFR-binding peptide
  MOD_RES (14)..(15): Xaa is C or S
FYLISIANLAQPVXX

SEQ ID NO: 6132 - protein, 13 aa, Artificial Sequence
  GFR-binding peptide
FYLVSIANLQTPA

SEQ ID NO: 6133 - protein, 15 aa, Artificial Sequence
  GFR-binding peptide
  MOD_RES (14)..(14): Xaa is C or S
LYLVSIASLKTPAXT

SEQ ID NO: 6134 - protein, 13 aa, Artificial Sequence
  GFR-binding peptide
LYLISIASLDQPV

SEQ ID NO: 6135 - protein, 13 aa, Artificial Sequence
  GFR-binding peptide
FYLISIANLAQPV

SEQ ID NO: 6136 - protein, 19 aa, Artificial Sequence
  GFR-binding peptide
  MOD_RES (14)..(15): Xaa is C or S
LYLMSIASMKTPTXXPGAS

SEQ ID NO: 6137 - protein, 12 aa, Artificial Sequence
  GFR-binding peptide
LYLVSIASLKTP

SEQ ID NO: 6138 - protein, 15 aa, Artificial Sequence
  GFR-binding peptide
  MOD_RES (14)..(15): Xaa is C or S
LYLISIASLRTPVXX

SEQ ID NO: 6139 - protein, 14 aa, Artificial Sequence
  GFR-binding peptide
  MOD_RES (14)..(14): Xaa is C or S
LYLISIASLDQPVX

SEQ ID NO: 6140 - protein, 12 aa, Artificial Sequence
  GFR-binding peptide
FYLVSIANLQTP

SEQ ID NO: 6141 - protein, 13 aa, Artificial Sequence
  GFR-binding peptide
FYLMSIANLETPV

SEQ ID NO: 6142 - protein, 19 aa, Artificial Sequence
  GFR-binding peptide
  MOD_RES (14)..(15): Xaa is C or S
FYLMSIANMKTPTXXPGAS

SEQ ID NO: 6143 - protein, 18 aa, Artificial Sequence
  GFR-binding peptide
  MOD_RES (14)..(15): Xaa is C or S
LYLVSIASLKTPAXXPKP

SEQ ID NO: 6144 - protein, 16 aa, Artificial Sequence
  GFR-binding peptide
  MOD_RES (14)..(15): Xaa is C or S
LYLISIASMKEPVXXP

SEQ ID NO: 6145 - protein, 14 aa, Artificial Sequence
  GFR-binding peptide
  MOD_RES (14)..(14): Xaa is C or S
FYLISIANLDQSVX

SEQ ID NO: 6146 - protein, 18 aa, Artificial Sequence
  GFR-binding peptide
  MOD_RES (14)..(15): Xaa is C or S
FYLISIANLKTPVXXAKS

SEQ ID NO: 6147 - protein, 16 aa, Artificial Sequence
  GFR-binding peptide
  MOD_RES (14)..(15): Xaa is C or S
FYLISIANMKEPVXXP

SEQ ID NO: 6148 - protein, 10 aa, Artificial Sequence
  GFR-binding peptide
FYLMSIANMK

SEQ ID NO: 6149 - protein, 10 aa, Artificial Sequence
  GFR-binding peptide
LYLMSIASMK

SEQ ID NO: 6150 - protein, 14 aa, Artificial Sequence
  GFR-binding peptide
  MOD_RES (14)..(14): Xaa is C or S
FYLISIANLDQPVX

SEQ ID NO: 6151 - protein, 15 aa, Artificial Sequence
  GFR-binding peptide
  MOD_RES (14)..(15): Xaa is C or S
FYLISIANLRTPVXX

SEQ ID NO: 6152 - protein, 13 aa, Artificial Sequence
  GFR-binding peptide
FYLISIANLDQPV

SEQ ID NO: 6153 - protein, 11 aa, Artificial Sequence
  GFR-binding peptide
FYLISIANLRT

SEQ ID NO: 6154 - protein, 15 aa, Artificial Sequence
  GFR-binding peptide
  MOD_RES (14)..(15): Xaa is C or S
LYLISIASLKTPVXX

SEQ ID NO: 6155 - protein, 17 aa, Artificial Sequence
  GFR-binding peptide
  MOD_RES (14)..(15): Xaa is C or S
FYLVSIANLQTPAXXPK

SEQ ID NO: 6156 - protein, 16 aa, Artificial Sequence
  GFR-binding peptide
  MOD_RES (14)..(15): Xaa is C or S
FYLISIANLDQSVXXP

SEQ ID NO: 6157 - protein, 19 aa, Artificial Sequence
  GFR-binding peptide
  MOD_RES (14)..(15): Xaa is C or S
FYLVSIANLKTPVXXAKGV

SEQ ID NO: 6158 - protein, 15 aa, Artificial Sequence
  GFR-binding peptide
  MOD_RES (14)..(15): Xaa is C or S
LYLVSIASLKTPAXX

SEQ ID NO: 6159 - protein, 11 aa, Artificial Sequence
  GFR-binding peptide
LYLISIASMKE

SEQ ID NO: 6160 - protein, 14 aa, Artificial Sequence
  GFR-binding peptide
  MOD_RES (14)..(14): Xaa is C or S
FYLISIANLRAPVX

SEQ ID NO: 6161 - protein, 17 aa, Artificial Sequence
  GFR-binding peptide
  MOD_RES (14)..(15): Xaa is C or S
FYLISIANMKEPVXXPE

SEQ ID NO: 6162 - protein, 12 aa, Artificial Sequence
  GFR-binding peptide
FYLISIANMKEP

SEQ ID NO: 6163 - protein, 14 aa, Artificial Sequence
  GFR-binding peptide
  MOD_RES (14)..(14): Xaa is C or S
FYLMSIANLETPVX

SEQ ID NO: 6164 - protein, 16 aa, Artificial Sequence
  GFR-binding peptide
  MOD_RES (14)..(15): Xaa is C or S
FYLVSIANLKTPVXXA

SEQ ID NO: 6165 - protein, 17 aa, Artificial Sequence
  GFR-binding peptide
  MOD_RES (14)..(15): Xaa is C or S
LYLISIASLDQSVXXPS

SEQ ID NO: 6166 - protein, 9 aa, Artificial Sequence
  GFR-binding peptide
LYLISIASL

SEQ ID NO: 6167 - protein, 17 aa, Artificial Sequence
  GFR-binding peptide
  MOD_RES (14)..(15): Xaa is C or S
LYLMSIASTKVPAXXTS

SEQ ID NO: 6168 - protein, 17 aa, Artificial Sequence
  GFR-binding peptide
  MOD_RES (14)..(15): Xaa is C or S
FYLVSIANLKTPAXXPK

SEQ ID NO: 6169 - protein, 20 aa, Artificial Sequence
  GFR-binding peptide
  MOD_RES (14)..(15): Xaa is C or S
FYLISIANLDQPVXXPSASA

SEQ ID NO: 6170 - protein, 10 aa, Artificial Sequence
  GFR-binding peptide
FYLISIANLD

SEQ ID NO: 6171 - protein, 8 aa, Artificial Sequence
  GFR-binding peptide
FYLVSIAN

SEQ ID NO: 6172 - protein, 18 aa, Artificial Sequence
  GFR-binding peptide
  MOD_RES (14)..(15): Xaa is C or S
LYLVSIASLQTPAXXPKP

SEQ ID NO: 6173 - protein, 18 aa, Artificial Sequence
  GFR-binding peptide
  MOD_RES (14)..(15): Xaa is C or S
FYLMSIANTKVPAXXTSP

SEQ ID NO: 6174 - protein, 16 aa, Artificial Sequence
  GFR-binding peptide
  MOD_RES (14)..(15): Xaa is C or S
FYLVSIANLQTPAXXP

SEQ ID NO: 6175 - protein, 15 aa, Artificial Sequence
  GFR-binding peptide
  MOD_RES (14)..(15): Xaa is C or S
LYLVSIASLQTPAXX

SEQ ID NO: 6176 - protein, 12 aa, Artificial Sequence
  GFR-binding peptide
LYLVSIASLQTP

SEQ ID NO: 6177 - protein, 11 aa, Artificial Sequence
  GFR-binding peptide
LYLISIASLKT

SEQ ID NO: 6178 - protein, 20 aa, Artificial Sequence
  GFR-binding peptide
  MOD_RES (14)..(15): Xaa is C or S
LYLMSIASLETPVXXAKPIK

SEQ ID NO: 6179 - protein, 20 aa, Artificial Sequence
  GFR-binding peptide
  MOD_RES (14)..(15): Xaa is C or S
FYLISIANLAQPVXXPAASA

SEQ ID NO: 6180 - protein, 19 aa, Artificial Sequence
  GFR-binding peptide
  MOD_RES (14)..(14): Xaa is C or S
LYLVSIASLKTPAXTPKTV

SEQ ID NO: 6181 - protein, 20 aa, Artificial Sequence
  GFR-binding peptide
  MOD_RES (14)..(15): Xaa is C or S
LYLISIASLAQPVXXPAASA

SEQ ID NO: 6182 - protein, 14 aa, Artificial Sequence
  GFR-binding peptide
  MOD_RES (14)..(14): Xaa is C or S
FYLVSIANLKTPVX

SEQ ID NO: 6183 - protein, 18 aa, Artificial Sequence
  GFR-binding peptide
  MOD_RES (14)..(15): Xaa is C or S
FYLISIANLDQSVXXPSA

SEQ ID NO: 6184 - protein, 16 aa, Artificial Sequence
  GFR-binding peptide
  MOD_RES (14)..(15): Xaa is C or S
LYLISIASLRTPVXXT

SEQ ID NO: 6185 - protein, 16 aa, Artificial Sequence
  GFR-binding peptide
  MOD_RES (14)..(15): Xaa is C or S
FYLMSIANTKVPAXXT

SEQ ID NO: 6186 - protein, 13 aa, Artificial Sequence
  GFR-binding peptide
LYLMSIASTKVPA

SEQ ID NO: 6187 - protein, 12 aa, Artificial Sequence
  GFR-binding peptide
LYLISIASLAQP

SEQ ID NO: 6188 - protein, 14 aa, Artificial Sequence
  GFR-binding peptide
  MOD_RES (14)..(14): Xaa is C or S
LYLVSIASLKTPVX

SEQ ID NO: 6189 - protein, 16 aa, Artificial Sequence
  GFR-binding peptide
  MOD_RES (14)..(15): Xaa is C or S
LYLVSIASLKTPVXXA

SEQ ID NO: 6190 - protein, 18 aa, Artificial Sequence
  GFR-binding peptide
  MOD_RES (14)..(14): Xaa is C or S
FYLVSIANLKTPAXTPKT

SEQ ID NO: 6191 - protein, 12 aa, Artificial Sequence
  GFR-binding peptide
FYLMSIANTKVP

SEQ ID NO: 6192 - protein, 13 aa, Artificial Sequence
  GFR-binding peptide
FYLMSIANTKVPA

SEQ ID NO: 6193 - protein, 14 aa, Artificial Sequence
  GFR-binding peptide
  MOD_RES (14)..(14): Xaa is C or S
FYLMSIANMKTPTX

SEQ ID NO: 6194 - protein, 12 aa, Artificial Sequence
  GFR-binding peptide
FYLISIANLAQP

SEQ ID NO: 6195 - protein, 12 aa, Artificial Sequence
  GFR-binding peptide
LYLMSIASTKVP

SEQ ID NO: 6196 - protein, 12 aa, Artificial Sequence
  GFR-binding peptide
LYLISIASLDQP

SEQ ID NO: 6197 - protein, 15 aa, Artificial Sequence
  GFR-binding peptide
  MOD_RES (14)..(15): Xaa is C or S
FYLVSIANLKTPAXX

SEQ ID NO: 6198 - protein, 17 aa, Artificial Sequence
  GFR-binding peptide
  MOD_RES (14)..(15): Xaa is C or S
FYLISIANLKTPVXXAK

SEQ ID NO: 6199 - protein, 18 aa, Artificial Sequence
  GFR-binding peptide
  MOD_RES (14)..(15): Xaa is C or S
LYLMSIASTKVPAXXTSP

SEQ ID NO: 6200 - protein, 17 aa, Artificial Sequence
  GFR-binding peptide
  MOD_RES (14)..(15): Xaa is C or S
FYLISIANLRTPVXXTP

SEQ ID NO: 6201 - protein, 16 aa, Artificial Sequence
  GFR-binding peptide
  MOD_RES (14)..(15): Xaa is C or S
LYLISIASLDQSVXXP

SEQ ID NO: 6202 - protein, 17 aa, Artificial Sequence
  GFR-binding peptide
  MOD_RES (14)..(15): Xaa is C or S
LYLISIASMKEPVXXPE

SEQ ID NO: 6203 - protein, 15 aa, Artificial Sequence
  GFR-binding peptide
  MOD_RES (14)..(15): Xaa is C or S
LYLMSIASTKVPAXX

SEQ ID NO: 6204 - protein, 18 aa, Artificial Sequence
  GFR-binding peptide
  MOD_RES (14)..(15): Xaa is C or S
LYLISIASLKTPVXXAKS

SEQ ID NO: 6205 - protein, 12 aa, Artificial Sequence
  GFR-binding peptide
FYLMSIANMKTP

SEQ ID NO: 6206 - protein, 18 aa, Artificial Sequence
  GFR-binding peptide
  MOD_RES (14)..(14): Xaa is C or S
LYLVSIASLKTPAXTPKT

SEQ ID NO: 6207 - protein, 11 aa, Artificial Sequence
  GFR-binding peptide
FYLISIANLKT

SEQ ID NO: 6208 - protein, 16 aa, Artificial Sequence
  GFR-binding peptide
  MOD_RES (14)..(15): Xaa is C or S
LYLMSIASTKVPAXXT

SEQ ID NO: 6209 - protein, 18 aa, Artificial Sequence
  GFR-binding peptide
  MOD_RES (14)..(15): Xaa is C or S
FYLVSIANLKTPAXXPKP

SEQ ID NO: 6210 - protein, 18 aa, Artificial Sequence
  GFR-binding peptide
  MOD_RES (14)..(15): Xaa is C or S
LYLISIASLRTPVXXTPP

SEQ ID NO: 6211 - protein, 12 aa, Artificial Sequence
  GFR-binding peptide
FYLVSIANLKTP

SEQ ID NO: 6212 - protein, 17 aa, Artificial Sequence
  GFR-binding peptide
  MOD_RES (14)..(15): Xaa is C or S
FYLISIANLDQSVXXPS

SEQ ID NO: 6213 - protein, 12 aa, Artificial Sequence
  GFR-binding peptide
LYLMSIASLETP

SEQ ID NO: 6214 - protein, 18 aa, Artificial Sequence
  GFR-binding peptide
  MOD_RES (14)..(15): Xaa is C or S
LYLISIASLDQSVXXPSA

SEQ ID NO: 6215 - protein, 17 aa, Artificial Sequence
  GFR-binding peptide
  MOD_RES (14)..(15): Xaa is C or S
LYLVSIASLQTPAXXPK

SEQ ID NO: 6216 - protein, 17 aa, Artificial Sequence
  GFR-binding peptide
  MOD_RES (14)..(15): Xaa is C or S
FYLMSIANTKVPAXXTS

SEQ ID NO: 6217 - protein, 9 aa, Artificial Sequence
  GFR-binding peptide
FYLISIANL

SEQ ID NO: 6218 - protein, 14 aa, Artificial Sequence
  GFR-binding peptide
  MOD_RES (14)..(14): Xaa is C or S
LYLMSIASLETPVX

SEQ ID NO: 6219 - protein, 13 aa, Artificial Sequence
  GFR-binding peptide
TQVQLRSVKVAKV

SEQ ID NO: 6220 - protein, 13 aa, Artificial Sequence
  GFR-binding peptide
VPTGQRPVQMRKI

SEQ ID NO: 6221 - protein, 11 aa, Artificial Sequence
  GFR-binding peptide
TEERPVQMRKI

SEQ ID NO: 6222 - protein, 15 aa, Artificial Sequence
  GFR-binding peptide
  MOD_RES (1)..(2): Xaa is C or S
XXVSQDLRSVKIAKV

SEQ ID NO: 6223 - protein, 14 aa, Artificial Sequence
  GFR-binding peptide
PSRVHHRPVQVRKI

SEQ ID NO: 6224 - protein, 10 aa, Artificial Sequence
  GFR-binding peptide
ALRPVQIRKI

SEQ ID NO: 6225 - protein, 19 aa, Artificial Sequence
  GFR-binding peptide
  MOD_RES (6)..(6): Xaa is C or S
DEGLEXVPTGQRPVQMRKI

SEQ ID NO: 6226 - protein, 19 aa, Artificial Sequence
  GFR-binding peptide
  MOD_RES (5)..(6): Xaa is C or S
SAAPXXVPQALRPVQIRKI

SEQ ID NO: 6227 - protein, 14 aa, Artificial Sequence
  GFR-binding peptide
  MOD_RES (1)..(1): Xaa is C or S
XVPTEERSVKMAKV

SEQ ID NO: 6228 - protein, 16 aa, Artificial Sequence
  GFR-binding peptide
  MOD_RES (2)..(3): Xaa is C or S
PXXVPQALRPVQIRKI

SEQ ID NO: 6229 - protein, 12 aa, Artificial Sequence
  GFR-binding peptide
SQDLRSVKIAKV

SEQ ID NO: 6230 - protein, 16 aa, Artificial Sequence
  GFR-binding peptide
  MOD_RES (2)..(3): Xaa is C or S
PXXVPQDLRSVKIAKV

SEQ ID NO: 6231 - protein, 20 aa, Artificial Sequence
  GFR-binding peptide
  MOD_RES (6)..(7): Xaa is C or S
ASASPXXVPQDLRSVKIAKV

SEQ ID NO: 6232 - protein, 19 aa, Artificial Sequence
  GFR-binding peptide
  MOD_RES (5)..(6): Xaa is C or S
SASPXXVSQDLRPVQIRKI

SEQ ID NO: 6233 - protein, 15 aa, Artificial Sequence
  GFR-binding peptide
  MOD_RES (1)..(2): Xaa is C or S
XXVPQDLRSVKIAKV

SEQ ID NO: 6234 - protein, 15 aa, Artificial Sequence
  GFR-binding peptide
RPTQVQLRSVKVAKV

SEQ ID NO: 6235 - protein, 9 aa, Artificial Sequence
  GFR-binding peptide
QRPVQMRKI

SEQ ID NO: 6236 - protein, 20 aa, Artificial Sequence
  GFR-binding peptide
  MOD_RES (6)..(7): Xaa is C or S
ASAAPXXVPQALRSVKIAKV

SEQ ID NO: 6237 - protein, 15 aa, Artificial Sequence
  GFR-binding peptide
QPSRVHHRPVQVRKI

SEQ ID NO: 6238 - protein, 14 aa, Artificial Sequence
  GFR-binding peptide
  MOD_RES (1)..(1): Xaa is C or S
XVPTGQRPVQMRKI

SEQ ID NO: 6239 - protein, 16 aa, Artificial Sequence
  GFR-binding peptide
  MOD_RES (3)..(3): Xaa is C or S
LEXVPTGQRSVKMAKV

SEQ ID NO: 6240 - protein, 19 aa, Artificial Sequence
  GFR-binding peptide
  MOD_RES (4)..(4): Xaa is C or S
SVKXQPSRVHHRPVQVRKI

SEQ ID NO: 6241 - protein, 15 aa, Artificial Sequence
  GFR-binding peptide
  MOD_RES (1)..(2): Xaa is C or S
XXVPQALRPVQIRKI

SEQ ID NO: 6242 - protein, 11 aa, Artificial Sequence
  GFR-binding peptide
TGQRSVKMAKV

SEQ ID NO: 6243 - protein, 11 aa, Artificial Sequence
  GFR-binding peptide
QDLRSVKIAKV

SEQ ID NO: 6244 - protein, 17 aa, Artificial Sequence
  GFR-binding peptide
  MOD_RES (4)..(4): Xaa is C or S
GLEXVPTEERPVQMRKI

SEQ ID NO: 6245 - protein, 19 aa, Artificial Sequence
  GFR-binding peptide
  MOD_RES (6)..(6): Xaa is C or S
DEGLEXVPTEERSVKMAKV

SEQ ID NO: 6246 - protein, 16 aa, Artificial Sequence
  GFR-binding peptide
  MOD_RES (2)..(3): Xaa is C or S
PXXVSQDLRSVKIAKV

SEQ ID NO: 6247 - protein, 9 aa, Artificial Sequence
  GFR-binding peptide
LRPVQIRKI

SEQ ID NO: 6248 - protein, 18 aa, Artificial Sequence
  GFR-binding peptide
  MOD_RES (4)..(5): Xaa is C or S
ASPXXVPQDLRPVQIRKI

SEQ ID NO: 6249 - protein, 17 aa, Artificial Sequence
  GFR-binding peptide
  MOD_RES (3)..(4): Xaa is C or S
SPXXVSQDLRPVQIRKI

SEQ ID NO: 6250 - protein, 13 aa, Artificial Sequence
  GFR-binding peptide
VPTEERSVKMAKV

SEQ ID NO: 6251 - protein, 19 aa, Artificial Sequence
  GFR-binding peptide
  MOD_RES (5)..(6): Xaa is C or S
SASPXXVPQDLRPVQIRKI

SEQ ID NO: 6252 - protein, 20 aa, Artificial Sequence
  GFR-binding peptide
  MOD_RES (7)..(7): Xaa is C or S
NDEGLEXVPTEERSVKMAKV

SEQ ID NO: 6253 - protein, 16 aa, Artificial Sequence
  GFR-binding peptide
  MOD_RES (3)..(3): Xaa is C or S
LEXVPTEERPVQMRKI

SEQ ID NO: 6254 - protein, 18 aa, Artificial Sequence
  GFR-binding peptide
  MOD_RES (3)..(3): Xaa is C or S
VQXRPTQVQLRSVKVAKV

SEQ ID NO: 6255 - protein, 11 aa, Artificial Sequence
  GFR-binding peptide
QDLRPVQIRKI

SEQ ID NO: 6256 - protein, 12 aa, Artificial Sequence
  GFR-binding peptide
RVHHRPVQVRKI

SEQ ID NO: 6257 - protein, 18 aa, Artificial Sequence
  GFR-binding peptide
  MOD_RES (4)..(5): Xaa is C or S
AAPXXVPQALRPVQIRKI

SEQ ID NO: 6258 - protein, 10 aa, Artificial Sequence
  GFR-binding peptide
HHRPVQVRKI

SEQ ID NO: 6259 - protein, 15 aa, Artificial Sequence
  GFR-binding peptide
  MOD_RES (2)..(2): Xaa is C or S
EXVPTGQRSVKMAKV

SEQ ID NO: 6260 - protein, 10 aa, Artificial Sequence
  GFR-binding peptide
GQRSVKMAKV

SEQ ID NO: 6261 - protein, 17 aa, Artificial Sequence
  GFR-binding peptide
  MOD_RES (3)..(4): Xaa is C or S
APXXVPQALRPVQIRKI

SEQ ID NO: 6262 - protein, 17 aa, Artificial Sequence
  GFR-binding peptide
  MOD_RES (3)..(4): Xaa is C or S
APXXVPQALRSVKIAKV

SEQ ID NO: 6263 - protein, 13 aa, Artificial Sequence
  GFR-binding peptide
VPQDLRSVKIAKV

SEQ ID NO: 6264 - protein, 12 aa, Artificial Sequence
  GFR-binding peptide
PTEERPVQMRKI

SEQ ID NO: 6265 - protein, 15 aa, Artificial Sequence
  GFR-binding peptide
  MOD_RES (2)..(2): Xaa is C or S
EXVPTEERSVKMAKV

SEQ ID NO: 6266 - protein, 10 aa, Artificial Sequence
  GFR-binding peptide
DLRSVKIAKV

SEQ ID NO: 6267 - protein, 10 aa, Artificial Sequence
  GFR-binding peptide
EERSVKMAKV

SEQ ID NO: 6268 - protein, 13 aa, Artificial Sequence
  GFR-binding peptide
VSQDLRSVKIAKV

SEQ ID NO: 6269 - protein, 14 aa, Artificial Sequence
  GFR-binding peptide
  MOD_RES (1)..(1): Xaa is C or S
XVPTEERPVQMRKI

SEQ ID NO: 6270 - protein, 19 aa, Artificial Sequence
  GFR-binding peptide
  MOD_RES (6)..(6): Xaa is C or S
DEGLEXVPTGQRSVKMAKV

SEQ ID NO: 6271 - protein, 11 aa, Artificial Sequence
  GFR-binding peptide
QALRSVKIAKV

SEQ ID NO: 6272 - protein, 20 aa, Artificial Sequence
  GFR-binding peptide
  MOD_RES (6)..(7): Xaa is C or S
ASASPXXVSQDLRSVKIAKV

SEQ ID NO: 6273 - protein, 12 aa, Artificial Sequence
  GFR-binding peptide
QVQLRSVKVAKV

SEQ ID NO: 6274 - protein, 17 aa, Artificial Sequence
  GFR-binding peptide
  MOD_RES (3)..(4): Xaa is C or S
SPXXVPQDLRSVKIAKV

SEQ ID NO: 6275 - protein, 12 aa, Artificial Sequence
  GFR-binding peptide
PQALRPVQIRKI

SEQ ID NO: 6276 - protein, 14 aa, Artificial Sequence
  GFR-binding peptide
  MOD_RES (1)..(1): Xaa is C or S
XVPQALRPVQIRKI

SEQ ID NO: 6277 - protein, 9 aa, Artificial Sequence
  GFR-binding peptide
QRSVKMAKV

SEQ ID NO: 6278 - protein, 9 aa, Artificial Sequence
  GFR-binding peptide
LRSVKVAKV

SEQ ID NO: 6279 - protein, 10 aa, Artificial Sequence
  GFR-binding peptide
QLRSVKVAKV

SEQ ID NO: 6280 - protein, 18 aa, Artificial Sequence
  GFR-binding peptide
  MOD_RES (4)..(5): Xaa is C or S
ASPXXVSQDLRPVQIRKI

SEQ ID NO: 6281 - protein, 19 aa, Artificial Sequence
  GFR-binding peptide
  MOD_RES (4)..(4): Xaa is C or S
NVQXRPTQVQLRSVKVAKV

SEQ ID NO: 6282 - protein, 20 aa, Artificial Sequence
  GFR-binding peptide
  MOD_RES (6)..(7): Xaa is C or S
ASASPXXVSQDLRPVQIRKI

SEQ ID NO: 6283 - protein, 14 aa, Artificial Sequence
  GFR-binding peptide
  MOD_RES (1)..(1): Xaa is C or S
XVPTGQRSVKMAKV

SEQ ID NO: 6284 - protein, 16 aa, Artificial Sequence
  GFR-binding peptide
  MOD_RES (2)..(3): Xaa is C or S
PXXVSQDLRPVQIRKI

SEQ ID NO: 6285 - protein, 19 aa, Artificial Sequence
  GFR-binding peptide
  MOD_RES (6)..(6): Xaa is C or S
DEGLEXVPTEERPVQMRKI

SEQ ID NO: 6286 - protein, 12 aa, Artificial Sequence
  GFR-binding peptide
PQALRSVKIAKV

SEQ ID NO: 6287 - protein, 11 aa, Artificial Sequence
  GFR-binding peptide
TGQRPVQMRKI

SEQ ID NO: 6288 - protein, 16 aa, Artificial Sequence
  GFR-binding peptide
  MOD_RES (3)..(3): Xaa is C or S
LEXVPTGQRPVQMRKI

SEQ ID NO: 6289 - protein, 20 aa, Artificial Sequence
  GFR-binding peptide
  MOD_RES (6)..(7): Xaa is C or S
ASASPXXVPQDLRPVQIRKI

SEQ ID NO: 6290 - protein, 13 aa, Artificial Sequence
  GFR-binding peptide
VPTEERPVQMRKI

SEQ ID NO: 6291 - protein, 16 aa, Artificial Sequence
  GFR-binding peptide
  MOD_RES (2)..(3): Xaa is C or S
PXXVPQALRSVKIAKV

SEQ ID NO: 6292 - protein, 18 aa, Artificial Sequence
  GFR-binding peptide
  MOD_RES (4)..(5): Xaa is C or S
ASPXXVSQDLRSVKIAKV

SEQ ID NO: 6293 - protein, 18 aa, Artificial Sequence
  GFR-binding peptide
  MOD_RES (4)..(5): Xaa is C or S
ASPXXVPQDLRSVKIAKV

SEQ ID NO: 6294 - protein, 12 aa, Artificial Sequence
  GFR-binding peptide
SQDLRPVQIRKI

SEQ ID NO: 6295 - protein, 12 aa, Artificial Sequence
  GFR-binding peptide
PQDLRPVQIRKI

SEQ ID NO: 6296 - protein, 13 aa, Artificial Sequence
  GFR-binding peptide
VPTGQRSVKMAKV

SEQ ID NO: 6297 - protein, 17 aa, Artificial Sequence
  GFR-binding peptide
  MOD_RES (3)..(4): Xaa is C or S
SPXXVSQDLRSVKIAKV

SEQ ID NO: 6298 - protein, 15 aa, Artificial Sequence
  GFR-binding peptide
  MOD_RES (1)..(2): Xaa is C or S
XXVPQALRSVKIAKV

SEQ ID NO: 6299 - protein, 9 aa, Artificial Sequence
  GFR-binding peptide
LRSVKIAKV

SEQ ID NO: 6300 - protein, 20 aa, Artificial Sequence
  GFR-binding peptide
  MOD_RES (6)..(7): Xaa is C or S
ASAAPXXVPQALRPVQIRKI

SEQ ID NO: 6301 - protein, 18 aa, Artificial Sequence
  GFR-binding peptide
  MOD_RES (5)..(5): Xaa is C or S
EGLEXVPTGQRSVKMAKV

SEQ ID NO: 6302 - protein, 16 aa, Artificial Sequence
  GFR-binding peptide
  MOD_RES (1)..(1): Xaa is C or S
XRPTQVQLRSVKVAKV

SEQ ID NO: 6303 - protein, 14 aa, Artificial Sequence
  GFR-binding peptide
PTQVQLRSVKVAKV

SEQ ID NO: 6304 - protein, 13 aa, Artificial Sequence
  GFR-binding peptide
SRVHHRPVQVRKI

SEQ ID NO: 6305 - protein, 10 aa, Artificial Sequence
  GFR-binding peptide
ALRSVKIAKV

SEQ ID NO: 6306 - protein, 14 aa, Artificial Sequence
  GFR-binding peptide
  MOD_RES (1)..(1): Xaa is C or S
XVPQDLRPVQIRKI

SEQ ID NO: 6307 - protein, 12 aa, Artificial Sequence
  GFR-binding peptide
PTGQRPVQMRKI

SEQ ID NO: 6308 - protein, 15 aa, Artificial Sequence
  GFR-binding peptide
  MOD_RES (1)..(2): Xaa is C or S
XXVSQDLRPVQIRKI

SEQ ID NO: 6309 - protein, 19 aa, Artificial Sequence
  GFR-binding peptide
  MOD_RES (5)..(6): Xaa is C or S
SAAPXXVPQALRSVKIAKV

SEQ ID NO: 6310 - protein, 19 aa, Artificial Sequence
  GFR-binding peptide
  MOD_RES (5)..(6): Xaa is C or S
SASPXXVSQDLRSVKIAKV

SEQ ID NO: 6311 - protein, 20 aa, Artificial Sequence
  GFR-binding peptide
  MOD_RES (7)..(7): Xaa is C or S
NDEGLEXVPTGQRSVKMAKV

SEQ ID NO: 6312 - protein, 16 aa, Artificial Sequence
  GFR-binding peptide
  MOD_RES (2)..(3): Xaa is C or S
PXXVPQDLRPVQIRKI

SEQ ID NO: 6313 - protein, 17 aa, Artificial Sequence
  GFR-binding peptide
  MOD_RES (4)..(4): Xaa is C or S
GLEXVPTGQRSVKMAKV

SEQ ID NO: 6314 - protein, 11 aa, Artificial Sequence
  GFR-binding peptide
TEERSVKMAKV

SEQ ID NO: 6315 - protein, 18 aa, Artificial Sequence
  GFR-binding peptide
  MOD_RES (5)..(5): Xaa is C or S
EGLEXVPTEERPVQMRKI

SEQ ID NO: 6316 - protein, 11 aa, Artificial Sequence
  GFR-binding peptide
QALRPVQIRKI

SEQ ID NO: 6317 - protein, 13 aa, Artificial Sequence
  GFR-binding peptide
VPQALRPVQIRKI

SEQ ID NO: 6318 - protein, 11 aa, Artificial Sequence
  GFR-binding peptide
VHHRPVQVRKI

SEQ ID NO: 6319 - protein, 14 aa, Artificial Sequence
  GFR-binding peptide
  MOD_RES (1)..(1): Xaa is C or S
XVPQALRSVKIAKV

SEQ ID NO: 6320 - protein, 9 aa, Artificial Sequence
  GFR-binding peptide
ERSVKMAKV

SEQ ID NO: 6321 - protein, 14 aa, Artificial Sequence
  GFR-binding peptide
  MOD_RES (1)..(1): Xaa is C or S
XVSQDLRSVKIAKV

SEQ ID NO: 6322 - protein, 18 aa, Artificial Sequence
  GFR-binding peptide
  MOD_RES (3)..(3): Xaa is C or S
VKXQPSRVHHRPVQVRKI

SEQ ID NO: 6323 - protein, 18 aa, Artificial Sequence
  GFR-binding peptide
  MOD_RES (5)..(5): Xaa is C or S
EGLEXVPTGQRPVQMRKI

SEQ ID NO: 6324 - protein, 20 aa, Artificial Sequence
  GFR-binding peptide
  MOD_RES (7)..(7): Xaa is C or S
NDEGLEXVPTGQRPVQMRKI

SEQ ID NO: 6325 - protein, 13 aa, Artificial Sequence
  GFR-binding peptide
VSQDLRPVQIRKI

SEQ ID NO: 6326 - protein, 17 aa, Artificial Sequence
  GFR-binding peptide
  MOD_RES (2)..(2): Xaa is C or S
QXRPTQVQLRSVKVAKV

SEQ ID NO: 6327 - protein, 11 aa, Artificial Sequence
  GFR-binding peptide
VQLRSVKVAKV

SEQ ID NO: 6328 - protein, 12 aa, Artificial Sequence
  GFR-binding peptide
PTEERSVKMAKV

SEQ ID NO: 6329 - protein, 17 aa, Artificial Sequence
  GFR-binding peptide
  MOD_RES (2)..(2): Xaa is C or S
KXQPSRVHHRPVQVRKI

SEQ ID NO: 6330 - protein, 14 aa, Artificial Sequence
  GFR-binding peptide
  MOD_RES (1)..(1): Xaa is C or S
XVSQDLRPVQIRKI

SEQ ID NO: 6331 - protein, 15 aa, Artificial Sequence
  GFR-binding peptide
  MOD_RES (2)..(2): Xaa is C or S
EXVPTGQRPVQMRKI

SEQ ID NO: 6332 - protein, 10 aa, Artificial Sequence
  GFR-binding peptide
GQRPVQMRKI

SEQ ID NO: 6333 - protein, 17 aa, Artificial Sequence
  GFR-binding peptide
  MOD_RES (3)..(4): Xaa is C or S
SPXXVPQDLRPVQIRKI

SEQ ID NO: 6334 - protein, 20 aa, Artificial Sequence
  GFR-binding peptide
  MOD_RES (7)..(7): Xaa is C or S
NDEGLEXVPTEERPVQMRKI

SEQ ID NO: 6335 - protein, 17 aa, Artificial Sequence
  GFR-binding peptide
  MOD_RES (4)..(4): Xaa is C or S
GLEXVPTEERSVKMAKV

SEQ ID NO: 6336 - protein, 18 aa, Artificial Sequence
  GFR-binding peptide
  MOD_RES (4)..(5): Xaa is C or S
AAPXXVPQALRSVKIAKV

SEQ ID NO: 6337 - protein, 17 aa, Artificial Sequence
  GFR-binding peptide
  MOD_RES (4)..(4): Xaa is C or S
GLEXVPTGQRPVQMRKI

SEQ ID NO: 6338 - protein, 9 aa, Artificial Sequence
  GFR-binding peptide
ERPVQMRKI

SEQ ID NO: 6339 - protein, 13 aa, Artificial Sequence
  GFR-binding peptide
VPQALRSVKIAKV

SEQ ID NO: 6340 - protein, 16 aa, Artificial Sequence
  GFR-binding peptide
  MOD_RES (3)..(3): Xaa is C or S
LEXVPTEERSVKMAKV

SEQ ID NO: 6341 - protein, 18 aa, Artificial Sequence
  GFR-binding peptide
  MOD_RES (5)..(5): Xaa is C or S
EGLEXVPTEERSVKMAKV

SEQ ID NO: 6342 - protein, 16 aa, Artificial Sequence
  GFR-binding peptide
  MOD_RES (1)..(1): Xaa is C or S
XQPSRVHHRPVQVRKI

SEQ ID NO: 6343 - protein, 9 aa, Artificial Sequence
  GFR-binding peptide
HRPVQVRKI

SEQ ID NO: 6344 - protein, 19 aa, Artificial Sequence
  GFR-binding peptide
  MOD_RES (5)..(6): Xaa is C or S
SASPXXVPQDLRSVKIAKV

SEQ ID NO: 6345 - protein, 15 aa, Artificial Sequence
  GFR-binding peptide
  MOD_RES (2)..(2): Xaa is C or S
EXVPTEERPVQMRKI

SEQ ID NO: 6346 - protein, 10 aa, Artificial Sequence
  GFR-binding peptide
DLRPVQIRKI

SEQ ID NO: 6347 - protein, 10 aa, Artificial Sequence
  GFR-binding peptide
EERPVQMRKI

SEQ ID NO: 6348 - protein, 12 aa, Artificial Sequence
  GFR-binding peptide
PTGQRSVKMAKV

SEQ ID NO: 6349 - protein, 13 aa, Artificial Sequence
  GFR-binding peptide
VPQDLRPVQIRKI

SEQ ID NO: 6350 - protein, 12 aa, Artificial Sequence
  GFR-binding peptide
PQDLRSVKIAKV

SEQ ID NO: 6351 - protein, 14 aa, Artificial Sequence
  GFR-binding peptide
  MOD_RES (1)..(1): Xaa is C or S
XVPQDLRSVKIAKV

SEQ ID NO: 6352 - protein, 15 aa, Artificial Sequence
  GFR-binding peptide
  MOD_RES (1)..(2): Xaa is C or S
XXVPQDLRPVQIRKI

SEQ ID NO: 6353 - protein, 4 aa, Artificial Sequence
  Building block peptide "PEP"
EPIS

SEQ ID NO: 6354 - protein, 4 aa, Artificial Sequence
  Building block peptide "PEP"
EPLP

SEQ ID NO: 6355 - protein, 4 aa, Artificial Sequence
  Building block peptide "PEP"
EPLT

SEQ ID NO: 6356 - protein, 4 aa, Artificial Sequence
  Building block peptide "PEP"
KPLS

SEQ ID NO: 6357 - protein, 4 aa, Artificial Sequence
  Building block peptide "PEP"
NAIS

SEQ ID NO: 6358 - protein, 4 aa, Artificial Sequence
  Building block peptide "PEP"
RPVQ

SEQ ID NO: 6359 - protein, 4 aa, Artificial Sequence
  Building block peptide "PEP"
RSVK

SEQ ID NO: 6360 - protein, 4 aa, Artificial Sequence
  Building block peptide "PEP"
SAIS

SEQ ID NO: 6361 - protein, 4 aa, Artificial Sequence
  Building block peptide "PEP"
SATS

SEQ ID NO: 6362 - protein, 4 aa, Artificial Sequence
  Building block peptide "PEP"
SNIT

SEQ ID NO: 6363 - protein, 4 aa, Artificial Sequence
  Building block peptide "PEP"
SPIN

SEQ ID NO: 6364 - protein, 4 aa, Artificial Sequence
  Building block peptide "PEP"
SPIS

SEQ ID NO: 6365 - protein, 4 aa, Artificial Sequence
  Building block peptide "PEP"
SSLS

SEQ ID NO: 6366 - protein, 5 aa, Artificial Sequence
  Building block peptide "PEP"
APTAL

SEQ ID NO: 6367 - protein, 5 aa, Artificial Sequence
  Building block peptide "PEP"
APTDL

SEQ ID NO: 6368 - protein, 5 aa, Artificial Sequence
  Building block peptide "PEP"
APTEL

SEQ ID NO: 6369 - protein, 5 aa, Artificial Sequence
  Building block peptide "PEP"
APTKL

SEQ ID NO: 6370 - protein, 5 aa, Artificial Sequence
  Building block peptide "PEP"
APTKM

SEQ ID NO: 6371 - protein, 5 aa, Artificial Sequence
  Building block peptide "PEP"
APTKT

SEQ ID NO: 6372 - protein, 5 aa, Artificial Sequence
  Building block peptide "PEP"
APTQL

SEQ ID NO: 6373 - protein, 5 aa, Artificial Sequence
  Building block peptide "PEP"
APTRL

SEQ ID NO: 6374 - protein, 5 aa, Artificial Sequence
  Building block peptide "PEP"
APVAL

SEQ ID NO: 6375 - protein, 5 aa, Artificial Sequence
  Building block peptide "PEP"
APVDL

SEQ ID NO: 6376 - protein, 5 aa, Artificial Sequence
  Building block peptide "PEP"
APVEL

SEQ ID NO: 6377 - protein, 5 aa, Artificial Sequence
  Building block peptide "PEP"
APVKL

SEQ ID NO: 6378 - protein, 5 aa, Artificial Sequence
  Building block peptide "PEP"
APVKM

SEQ ID NO: 6379 - protein, 5 aa, Artificial Sequence
  Building block peptide "PEP"
APVKT

SEQ ID NO: 6380 - protein, 5 aa, Artificial Sequence
  Building block peptide "PEP"
APVQL

SEQ ID NO: 6381 - protein, 5 aa, Artificial Sequence
  Building block peptide "PEP"
APVRL

SEQ ID NO: 6382 - protein, 5 aa, Artificial Sequence
  Building block peptide "PEP"
SRVHH

SEQ ID NO: 6383 - protein, 5 aa, Artificial Sequence
  Building block peptide "PEP"
SRVQL

SEQ ID NO: 6384 - protein, 5 aa, Artificial Sequence
  Building block peptide "PEP"
TPTAL

SEQ ID NO: 6385 - protein, 5 aa, Artificial Sequence
  Building block peptide "PEP"
TPTDL

SEQ ID NO: 6386 - protein, 5 aa, Artificial Sequence
  Building block peptide "PEP"
TPTEL

SEQ ID NO: 6387 - protein, 5 aa, Artificial Sequence
  Building block peptide "PEP"
TPTKL

SEQ ID NO: 6388 - protein, 5 aa, Artificial Sequence
  Building block peptide "PEP"
TPTKM

SEQ ID NO: 6389 - protein, 5 aa, Artificial Sequence
  Building block peptide "PEP"
TPTKT

SEQ ID NO: 6390 - protein, 5 aa, Artificial Sequence
  Building block peptide "PEP"
TPTQL

SEQ ID NO: 6391 - protein, 5 aa, Artificial Sequence
  Building block peptide "PEP"
TPTRL

SEQ ID NO: 6392 - protein, 5 aa, Artificial Sequence
  Building block peptide "PEP"
TQVHH

SEQ ID NO: 6393 - protein, 5 aa, Artificial Sequence
  Building block peptide "PEP"
TQVQL

SEQ ID NO: 6394 - protein, 5 aa, Artificial Sequence
  Building block peptide "PEP"
VPAAL

SEQ ID NO: 6395 - protein, 5 aa, Artificial Sequence
  Building block peptide "PEP"
VPADL

SEQ ID NO: 6396 - protein, 5 aa, Artificial Sequence
  Building block peptide "PEP"
VPAEL

SEQ ID NO: 6397 - protein, 5 aa, Artificial Sequence
  Building block peptide "PEP"
VPAKL

SEQ ID NO: 6398 - protein, 5 aa, Artificial Sequence
  Building block peptide "PEP"
VPAKM

SEQ ID NO: 6399 - protein, 5 aa, Artificial Sequence
  Building block peptide "PEP"
VPAKT

SEQ ID NO: 6400 - protein, 5 aa, Artificial Sequence
  Building block peptide "PEP"
VPAQL

SEQ ID NO: 6401 - protein, 5 aa, Artificial Sequence
  Building block peptide "PEP"
VPARL

SEQ ID NO: 6402 - protein, 5 aa, Artificial Sequence
  Building block peptide "PEP"
VPEAL

SEQ ID NO: 6403 - protein, 5 aa, Artificial Sequence
  Building block peptide "PEP"
VPEDL

SEQ ID NO: 6404 - protein, 5 aa, Artificial Sequence
  Building block peptide "PEP"
VPEEL

SEQ ID NO: 6405 - protein, 5 aa, Artificial Sequence
  Building block peptide "PEP"
VPEKL

SEQ ID NO: 6406 - protein, 5 aa, Artificial Sequence
  Building block peptide "PEP"
VPEKM

SEQ ID NO: 6407 - protein, 5 aa, Artificial Sequence
  Building block peptide "PEP"
VPEKT

SEQ ID NO: 6408 - protein, 5 aa, Artificial Sequence
  Building block peptide "PEP"
VPEQL

SEQ ID NO: 6409 - protein, 5 aa, Artificial Sequence
  Building block peptide "PEP"
VPERL

SEQ ID NO: 6410 - protein, 5 aa, Artificial Sequence
  Building block peptide "PEP"
VPQAL

SEQ ID NO: 6411 - protein, 5 aa, Artificial Sequence
  Building block peptide "PEP"
VPQDL

SEQ ID NO: 6412 - protein, 5 aa, Artificial Sequence
  Building block peptide "PEP"
VPQEL

SEQ ID NO: 6413 - protein, 5 aa, Artificial Sequence
  Building block peptide "PEP"
VPQKL

SEQ ID NO: 6414 - protein, 5 aa, Artificial Sequence
  Building block peptide "PEP"
VPQKM

SEQ ID NO: 6415 - protein, 5 aa, Artificial Sequence
  Building block peptide "PEP"
VPQKT

SEQ ID NO: 6416 - protein, 5 aa, Artificial Sequence
  Building block peptide "PEP"
VPQQL

SEQ ID NO: 6417 - protein, 5 aa, Artificial Sequence
  Building block peptide "PEP"
VPQRL

SEQ ID NO: 6418 - protein, 5 aa, Artificial Sequence
  Building block peptide "PEP"
VPTAL

SEQ ID NO: 6419 - protein, 5 aa, Artificial Sequence
  Building block peptide "PEP"
VPTDL

SEQ ID NO: 6420 - protein, 5 aa, Artificial Sequence
  Building block peptide "PEP"
VPTEE

SEQ ID NO: 6421 - protein, 5 aa, Artificial Sequence
  Building block peptide "PEP"
VPTEL

SEQ ID NO: 6422 - protein, 5 aa, Artificial Sequence
  Building block peptide "PEP"
VPTGQ

SEQ ID NO: 6423 - protein, 5 aa, Artificial Sequence
  Building block peptide "PEP"
VPTKL

SEQ ID NO: 6424 - protein, 5 aa, Artificial Sequence
  Building block peptide "PEP"
VPTKM

SEQ ID NO: 6425 - protein, 5 aa, Artificial Sequence
  Building block peptide "PEP"
VPTKT

SEQ ID NO: 6426 - protein, 5 aa, Artificial Sequence
  Building block peptide "PEP"
VPTQL

SEQ ID NO: 6427 - protein, 5 aa, Artificial Sequence
  Building block peptide "PEP"
VPTRL

SEQ ID NO: 6428 - protein, 5 aa, Artificial Sequence
  Building block peptide "PEP"
VSQAL

SEQ ID NO: 6429 - protein, 5 aa, Artificial Sequence
  Building block peptide "PEP"
VSQDL

SEQ ID NO: 6430 - protein, 5 aa, Artificial Sequence
  Building block peptide "PEP"
VSQEL

SEQ ID NO: 6431 - protein, 5 aa, Artificial Sequence
  Building block peptide "PEP"
VSQKL

SEQ ID NO: 6432 - protein, 5 aa, Artificial Sequence
  Building block peptide "PEP"
VSQKM

SEQ ID NO: 6433 - protein, 5 aa, Artificial Sequence
  Building block peptide "PEP"
VSQKT

SEQ ID NO: 6434 - protein, 5 aa, Artificial Sequence
  Building block peptide "PEP"
VSQQL

SEQ ID NO: 6435 - protein, 5 aa, Artificial Sequence
  Building block peptide "PEP"
VSQRL

SEQ ID NO: 6436 - protein, 7 aa, Artificial Sequence
  Building block peptide "PEP"
  MOD_RES (6)..(7): Xaa is C or S
AAPASXX

SEQ ID NO: 6437 - protein, 7 aa, Artificial Sequence
  Building block peptide "PEP"
  MOD_RES (6)..(7): Xaa is C or S
ASAAPXX

SEQ ID NO: 6438 - protein, 7 aa, Artificial Sequence
  Building block peptide "PEP"
  MOD_RES (6)..(7): Xaa is C or S
ASASPXX

SEQ ID NO: 6439 - protein, 7 aa, Artificial Sequence
  Building block peptide "PEP"
  MOD_RES (6)..(7): Xaa is C or S
AVPKAXX

SEQ ID NO: 6440 - protein, 7 aa, Artificial Sequence
  Building block peptide "PEP"
  MOD_RES (6)..(7): Xaa is C or S
GIPEPXX

SEQ ID NO: 6441 - protein, 7 aa, Artificial Sequence
  Building block peptide "PEP"
  MOD_RES (6)..(7): Xaa is C or S
GSAGPXX

SEQ ID NO: 6442 - protein, 7 aa, Artificial Sequence
  Building block peptide "PEP"
  MOD_RES (6)..(7): Xaa is C or S
HVPKPXX

SEQ ID NO: 6443 - protein, 7 aa, Artificial Sequence
  Building block peptide "PEP"
  MOD_RES (7)..(7): Xaa is C or S
HVTKPTX

SEQ ID NO: 6444 - protein, 7 aa, Artificial Sequence
  Building block peptide "PEP"
  MOD_RES (6)..(7): Xaa is C or S
KASKAXX

SEQ ID NO: 6445 - protein, 7 aa, Artificial Sequence
  Building block peptide "PEP"
  MOD_RES (6)..(7): Xaa is C or S
KIPKAXX

SEQ ID NO: 6446 - protein, 7 aa, Artificial Sequence
  Building block peptide "PEP"
  MOD_RES (6)..(7): Xaa is C or S
KVGKAXX

SEQ ID NO: 6447 - protein, 7 aa, Artificial Sequence
  Building block peptide "PEP"
  MOD_RES (7)..(7): Xaa is C or S
NDEGLEX

SEQ ID NO: 6448 - protein, 7 aa, Artificial Sequence
  Building block peptide "PEP"
  MOD_RES (5)..(5): Xaa is C or S
RNVQXRP

SEQ ID NO: 6449 - protein, 7 aa, Artificial Sequence
  Building block peptide "PEP"
  MOD_RES (6)..(7): Xaa is C or S
RVPSTXX

SEQ ID NO: 6450 - protein, 7 aa, Artificial Sequence
  Building block peptide "PEP"
  MOD_RES (6)..(7): Xaa is C or S
SIPKAXX

SEQ ID NO: 6451 - protein, 7 aa, Artificial Sequence
  Building block peptide "PEP"
  MOD_RES (5)..(5): Xaa is C or S
SSVKXQP

SEQ ID NO: 6452 - protein, 7 aa, Artificial Sequence
  Building block peptide "PEP"
  MOD_RES (6)..(7): Xaa is C or S
STPPTXX

SEQ ID NO: 6453 - protein, 7 aa, Artificial Sequence
  Building block peptide "PEP"
  MOD_RES (6)..(7): Xaa is C or S
TVPKPXX

SEQ ID NO: 6454 - protein, 7 aa, Artificial Sequence
  Building block peptide "PEP"
  MOD_RES (6)..(7): Xaa is C or S
YVPKPXX

SEQ ID NO: 6455 - protein, 12 aa, Artificial Sequence
  Building block peptide "PEP"
  MOD_RES (6)..(7): Xaa is C or S
AAPASXXAPTRL

SEQ ID NO: 6456 - protein, 12 aa, Artificial Sequence
  Building block peptide "PEP"
  MOD_RES (6)..(7): Xaa is C or S
AAPASXXAPVRL

SEQ ID NO: 6457 - protein, 12 aa, Artificial Sequence
  Building block peptide "PEP"
  MOD_RES (6)..(7): Xaa is C or S
AAPASXXTPTRL

SEQ ID NO: 6458 - protein, 12 aa, Artificial Sequence
  Building block peptide "PEP"
  MOD_RES (6)..(7): Xaa is C or S
AAPASXXVPARL

SEQ ID NO: 6459 - protein, 12 aa, Artificial Sequence
  Building block peptide "PEP"
  MOD_RES (6)..(7): Xaa is C or S
AAPASXXVPERL

SEQ ID NO: 6460 - protein, 12 aa, Artificial Sequence
  Building block peptide "PEP"
  MOD_RES (6)..(7): Xaa is C or S
AAPASXXVPQRL

SEQ ID NO: 6461 - protein, 12 aa, Artificial Sequence
  Building block peptide "PEP"
  MOD_RES (6)..(7): Xaa is C or S
AAPASXXVPTRL

SEQ ID NO: 6462 - protein, 12 aa, Artificial Sequence
  Building block peptide "PEP"
  MOD_RES (6)..(7): Xaa is C or S
AAPASXXVSQRL

SEQ ID NO: 6463 - protein, 12 aa, Artificial Sequence
  Building block peptide "PEP"
  MOD_RES (6)..(7): Xaa is C or S
ASAAPXXAPTAL

SEQ ID NO: 6464 - protein, 12 aa, Artificial Sequence
  Building block peptide "PEP"
  MOD_RES (6)..(7): Xaa is C or S
ASAAPXXAPVAL

SEQ ID NO: 6465 - protein, 12 aa, Artificial Sequence
  Building block peptide "PEP"
  MOD_RES (6)..(7): Xaa is C or S
ASAAPXXTPTAL

SEQ ID NO: 6466 - protein, 12 aa, Artificial Sequence
  Building block peptide "PEP"
  MOD_RES (6)..(7): Xaa is C or S
ASAAPXXVPAAL

SEQ ID NO: 6467 - protein, 12 aa, Artificial Sequence
  Building block peptide "PEP"
  MOD_RES (6)..(7): Xaa is C or S
ASAAPXXVPEAL

SEQ ID NO: 6468 - protein, 12 aa, Artificial Sequence
  Building block peptide "PEP"
  MOD_RES (6)..(7): Xaa is C or S
ASAAPXXVPQAL

SEQ ID NO: 6469 - protein, 12 aa, Artificial Sequence
  Building block peptide "PEP"
  MOD_RES (6)..(7): Xaa is C or S
ASAAPXXVPTAL

SEQ ID NO: 6470 - protein, 12 aa, Artificial Sequence
  Building block peptide "PEP"
  MOD_RES (6)..(7): Xaa is C or S
ASAAPXXVSQAL

SEQ ID NO: 6471 - protein, 12 aa, Artificial Sequence
  Building block peptide "PEP"
  MOD_RES (6)..(7): Xaa is C or S
ASASPXXAPTDL

SEQ ID NO: 6472 - protein, 12 aa, Artificial Sequence
  Building block peptide "PEP"
  MOD_RES (6)..(7): Xaa is C or S
ASASPXXAPVDL

SEQ ID NO: 6473 - protein, 12 aa, Artificial Sequence
  Building block peptide "PEP"
  MOD_RES (6)..(7): Xaa is C or S
ASASPXXTPTDL

SEQ ID NO: 6474 - protein, 12 aa, Artificial Sequence
  Building block peptide "PEP"
  MOD_RES (6)..(7): Xaa is C or S
ASASPXXVPADL

SEQ ID NO: 6475 - protein, 12 aa, Artificial Sequence
  Building block peptide "PEP"
  MOD_RES (6)..(7): Xaa is C or S
ASASPXXVPEDL

SEQ ID NO: 6476 - protein, 12 aa, Artificial Sequence
  Building block peptide "PEP"
  MOD_RES (6)..(7): Xaa is C or S
ASASPXXVPQDL

SEQ ID NO: 6477 - protein, 12 aa, Artificial Sequence
  Building block peptide "PEP"
  MOD_RES (6)..(7): Xaa is C or S
ASASPXXVPTDL

SEQ ID NO: 6478 - protein, 12 aa, Artificial Sequence
  Building block peptide "PEP"
  MOD_RES (6)..(7): Xaa is C or S
ASASPXXVSQDL

SEQ ID NO: 6479 - protein, 12 aa, Artificial Sequence
  Building block peptide "PEP"
  MOD_RES (6)..(7): Xaa is C or S
AVPKAXXAPTKL

SEQ ID NO: 6480 - protein, 12 aa, Artificial Sequence
  Building block peptide "PEP"
  MOD_RES (6)..(7): Xaa is C or S
AVPKAXXAPVKL

SEQ ID NO: 6481 - protein, 12 aa, Artificial Sequence
  Building block peptide "PEP"
  MOD_RES (6)..(7): Xaa is C or S
AVPKAXXTPTKL

SEQ ID NO: 6482 - protein, 12 aa, Artificial Sequence
  Building block peptide "PEP"
  MOD_RES (6)..(7): Xaa is C or S
AVPKAXXVPAKL

SEQ ID NO: 6483 - protein, 12 aa, Artificial Sequence
  Building block peptide "PEP"
  MOD_RES (6)..(7): Xaa is C or S
AVPKAXXVPEKL

SEQ ID NO: 6484 - protein, 12 aa, Artificial Sequence
  Building block peptide "PEP"
  MOD_RES (6)..(7): Xaa is C or S
AVPKAXXVPQKL

SEQ ID NO: 6485 - protein, 12 aa, Artificial Sequence
  Building block peptide "PEP"
  MOD_RES (6)..(7): Xaa is C or S
AVPKAXXVPTKL

SEQ ID NO: 6486 - protein, 12 aa, Artificial Sequence
  Building block peptide "PEP"
  MOD_RES (6)..(7): Xaa is C or S
AVPKAXXVSQKL

SEQ ID NO: 6487 - protein, 12 aa, Artificial Sequence
  Building block peptide "PEP"
  MOD_RES (6)..(7): Xaa is C or S
GIPEPXXAPTKM

SEQ ID NO: 6488 - protein, 12 aa, Artificial Sequence
  Building block peptide "PEP"
  MOD_RES (6)..(7): Xaa is C or S
GIPEPXXAPVKM

SEQ ID NO: 6489 - protein, 12 aa, Artificial Sequence
  Building block peptide "PEP"
  MOD_RES (6)..(7): Xaa is C or S
GIPEPXXTPTKM

SEQ ID NO: 6490 - protein, 12 aa, Artificial Sequence
  Building block peptide "PEP"
  MOD_RES (6)..(7): Xaa is C or S
GIPEPXXVPAKM

SEQ ID NO: 6491 - protein, 12 aa, Artificial Sequence
  Building block peptide "PEP"
  MOD_RES (6)..(7): Xaa is C or S
GIPEPXXVPEKM

SEQ ID NO: 6492 - protein, 12 aa, Artificial Sequence
  Building block peptide "PEP"
  MOD_RES (6)..(7): Xaa is C or S
GIPEPXXVPQKM

SEQ ID NO: 6493 - protein, 12 aa, Artificial Sequence
  Building block peptide "PEP"
  MOD_RES (6)..(7): Xaa is C or S
GIPEPXXVPTKM

SEQ ID NO: 6494 - protein, 12 aa, Artificial Sequence
  Building block peptide "PEP"
  MOD_RES (6)..(7): Xaa is C or S
GIPEPXXVSQKM

SEQ ID NO: 6495 - protein, 12 aa, Artificial Sequence
  Building block peptide "PEP"
  MOD_RES (6)..(7): Xaa is C or S
GSAGPXXAPTKM

SEQ ID NO: 6496 - protein, 12 aa, Artificial Sequence
  Building block peptide "PEP"
  MOD_RES (6)..(7): Xaa is C or S
GSAGPXXAPVKM

SEQ ID NO: 6497 - protein, 12 aa, Artificial Sequence
  Building block peptide "PEP"
  MOD_RES (6)..(7): Xaa is C or S
GSAGPXXTPTKM

SEQ ID NO: 6498 - protein, 12 aa, Artificial Sequence
  Building block peptide "PEP"
  MOD_RES (6)..(7): Xaa is C or S
GSAGPXXVPAKM

SEQ ID NO: 6499 - protein, 12 aa, Artificial Sequence
  Building block peptide "PEP"
  MOD_RES (6)..(7): Xaa is C or S
GSAGPXXVPEKM

SEQ ID NO: 6500 - protein, 12 aa, Artificial Sequence
  Building block peptide "PEP"
  MOD_RES (6)..(7): Xaa is C or S
GSAGPXXVPQKM

SEQ ID NO: 6501 - protein, 12 aa, Artificial Sequence
  Building block peptide "PEP"
  MOD_RES (6)..(7): Xaa is C or S
GSAGPXXVPTKM

SEQ ID NO: 6502 - protein, 12 aa, Artificial Sequence
  Building block peptide "PEP"
  MOD_RES (6)..(7): Xaa is C or S
GSAGPXXVSQKM

SEQ ID NO: 6503 - protein, 12 aa, Artificial Sequence
  Building block peptide "PEP"
  MOD_RES (6)..(7): Xaa is C or S
HVPKPXXAPTKL

SEQ ID NO: 6504 - protein, 12 aa, Artificial Sequence
  Building block peptide "PEP"
  MOD_RES (6)..(7): Xaa is C or S
HVPKPXXAPVKL

SEQ ID NO: 6505 - protein, 12 aa, Artificial Sequence
  Building block peptide "PEP"
  MOD_RES (6)..(7): Xaa is C or S
HVPKPXXTPTKL

SEQ ID NO: 6506 - protein, 12 aa, Artificial Sequence
  Building block peptide "PEP"
  MOD_RES (6)..(7): Xaa is C or S
HVPKPXXVPAKL

SEQ ID NO: 6507 - protein, 12 aa, Artificial Sequence
  Building block peptide "PEP"
  MOD_RES (6)..(7): Xaa is C or S
HVPKPXXVPEKL

SEQ ID NO: 6508 - protein, 12 aa, Artificial Sequence
  Building block peptide "PEP"
  MOD_RES (6)..(7): Xaa is C or S
HVPKPXXVPQKL

SEQ ID NO: 6509 - protein, 12 aa, Artificial Sequence
  Building block peptide "PEP"
  MOD_RES (6)..(7): Xaa is C or S
HVPKPXXVPTKL

SEQ ID NO: 6510 - protein, 12 aa, Artificial Sequence
  Building block peptide "PEP"
  MOD_RES (6)..(7): Xaa is C or S
HVPKPXXVSQKL

SEQ ID NO: 6511 - protein, 12 aa, Artificial Sequence
  Building block peptide "PEP"
  MOD_RES (7)..(7): Xaa is C or S
HVTKPTXAPTKL

SEQ ID NO: 6512 - protein, 12 aa, Artificial Sequence
  Building block peptide "PEP"
  MOD_RES (7)..(7): Xaa is C or S
HVTKPTXAPVKL

SEQ ID NO: 6513 - protein, 12 aa, Artificial Sequence
  Building block peptide "PEP"
  MOD_RES (7)..(7): Xaa is C or S
HVTKPTXSRVKL

SEQ ID NO: 6514 - protein, 12 aa, Artificial Sequence
  Building block peptide "PEP"
  MOD_RES (7)..(7): Xaa is C or S
HVTKPTXTPTKL

SEQ ID NO: 6515 - protein, 12 aa, Artificial Sequence
  Building block peptide "PEP"
  MOD_RES (7)..(7): Xaa is C or S
HVTKPTXTQVKL

SEQ ID NO: 6516 - protein, 12 aa, Artificial Sequence
  Building block peptide "PEP"
  MOD_RES (7)..(7): Xaa is C or S
HVTKPTXVPAKL

SEQ ID NO: 6517 - protein, 12 aa, Artificial Sequence
  Building block peptide "PEP"
  MOD_RES (7)..(7): Xaa is C or S
HVTKPTXVPEKL

SEQ ID NO: 6518 - protein, 12 aa, Artificial Sequence
  Building block peptide "PEP"
  MOD_RES (7)..(7): Xaa is C or S
HVTKPTXVPQKL

SEQ ID NO: 6519 - protein, 12 aa, Artificial Sequence
  Building block peptide "PEP"
  MOD_RES (7)..(7): Xaa is C or S
HVTKPTXVPTKL

SEQ ID NO: 6520 - protein, 12 aa, Artificial Sequence
  Building block peptide "PEP"
  MOD_RES (7)..(7): Xaa is C or S
HVTKPTXVSQKL

SEQ ID NO: 6521 - protein, 12 aa, Artificial Sequence
  Building block peptide "PEP"
  MOD_RES (6)..(7): Xaa is C or S
KASKAXXAPTKL

SEQ ID NO: 6522 - protein, 12 aa, Artificial Sequence
  Building block peptide "PEP"
  MOD_RES (6)..(7): Xaa is C or S
KASKAXXAPVKL

SEQ ID NO: 6523 - protein, 12 aa, Artificial Sequence
  Building block peptide "PEP"
  MOD_RES (6)..(7): Xaa is C or S
KASKAXXTPTKL

SEQ ID NO: 6524 - protein, 12 aa, Artificial Sequence
  Building block peptide "PEP"
  MOD_RES (6)..(7): Xaa is C or S
KASKAXXVPAKL

SEQ ID NO: 6525 - protein, 12 aa, Artificial Sequence
  Building block peptide "PEP"
  MOD_RES (6)..(7): Xaa is C or S
KASKAXXVPEKL

SEQ ID NO: 6526 - protein, 12 aa, Artificial Sequence
  Building block peptide "PEP"
  MOD_RES (6)..(7): Xaa is C or S
KASKAXXVPQKL

SEQ ID NO: 6527 - protein, 12 aa, Artificial Sequence
  Building block peptide "PEP"
  MOD_RES (6)..(7): Xaa is C or S
KASKAXXVPTKL

SEQ ID NO: 6528 - protein, 12 aa, Artificial Sequence
  Building block peptide "PEP"
  MOD_RES (6)..(7): Xaa is C or S
KASKAXXVSQKL

SEQ ID NO: 6529 - protein, 12 aa, Artificial Sequence
  Building block peptide "PEP"
  MOD_RES (6)..(7): Xaa is C or S
KIPKAXXAPTEL

SEQ ID NO: 6530 - protein, 12 aa, Artificial Sequence
  Building block peptide "PEP"
  MOD_RES (6)..(7): Xaa is C or S
KIPKAXXAPVEL

SEQ ID NO: 6531 - protein, 12 aa, Artificial Sequence
  Building block peptide "PEP"
  MOD_RES (6)..(7): Xaa is C or S
KIPKAXXTPTEL

SEQ ID NO: 6532 - protein, 12 aa, Artificial Sequence
  Building block peptide "PEP"
  MOD_RES (6)..(7): Xaa is C or S
KIPKAXXVPAEL

SEQ ID NO: 6533 - protein, 12 aa, Artificial Sequence
  Building block peptide "PEP"
  MOD_RES (6)..(7): Xaa is C or S
KIPKAXXVPEEL

SEQ ID NO: 6534 - protein, 12 aa, Artificial Sequence
  Building block peptide "PEP"
  MOD_RES (6)..(7): Xaa is C or S
KIPKAXXVPQEL

SEQ ID NO: 6535 - protein, 12 aa, Artificial Sequence
  Building block peptide "PEP"
  MOD_RES (6)..(7): Xaa is C or S
KIPKAXXVPTEL

SEQ ID NO: 6536 - protein, 12 aa, Artificial Sequence
  Building block peptide "PEP"
  MOD_RES (6)..(7): Xaa is C or S
KIPKAXXVSQEL

SEQ ID NO: 6537 - protein, 12 aa, Artificial Sequence
  Building block peptide "PEP"
  MOD_RES (6)..(7): Xaa is C or S
KVGKAXXAPTKL

SEQ ID NO: 6538 - protein, 12 aa, Artificial Sequence
  Building block peptide "PEP"
  MOD_RES (6)..(7): Xaa is C or S
KVGKAXXAPVKL

SEQ ID NO: 6539 - protein, 12 aa, Artificial Sequence
  Building block peptide "PEP"
  MOD_RES (6)..(7): Xaa is C or S
KVGKAXXTPTKL

SEQ ID NO: 6540 - protein, 12 aa, Artificial Sequence
  Building block peptide "PEP"
  MOD_RES (6)..(7): Xaa is C or S
KVGKAXXVPAKL

SEQ ID NO: 6541 - protein, 12 aa, Artificial Sequence
  Building block peptide "PEP"
  MOD_RES (6)..(7): Xaa is C or S
KVGKAXXVPEKL

SEQ ID NO: 6542 - protein, 12 aa, Artificial Sequence
  Building block peptide "PEP"
  MOD_RES (6)..(7): Xaa is C or S
KVGKAXXVPQKL

SEQ ID NO: 6543 - protein, 12 aa, Artificial Sequence
  Building block peptide "PEP"
  MOD_RES (6)..(7): Xaa is C or S
KVGKAXXVPTKL

SEQ ID NO: 6544 - protein, 12 aa, Artificial Sequence
  Building block peptide "PEP"
  MOD_RES (6)..(7): Xaa is C or S
KVGKAXXVSQKL

SEQ ID NO: 6545 - protein, 12 aa, Artificial Sequence
  Building block peptide "PEP"
  MOD_RES (7)..(7): Xaa is C or S
NDEGLEXVPTEE

SEQ ID NO: 6546 - protein, 12 aa, Artificial Sequence
  Building block peptide "PEP"
  MOD_RES (7)..(7): Xaa is C or S
NDEGLEXVPTGQ

SEQ ID NO: 6547 - protein, 12 aa, Artificial Sequence
  Building block peptide "PEP"
  MOD_RES (5)..(5): Xaa is C or S
RNVQXRPSRVQL

SEQ ID NO: 6548 - protein, 12 aa, Artificial Sequence
  Building block peptide "PEP"
  MOD_RES (5)..(5): Xaa is C or S
RNVQXRPTQVQL

SEQ ID NO: 6549 - protein, 12 aa, Artificial Sequence
  Building block peptide "PEP"
  MOD_RES (6)..(7): Xaa is C or S
RVPSTXXAPTKT

SEQ ID NO: 6550 - protein, 12 aa, Artificial Sequence
  Building block peptide "PEP"
  MOD_RES (6)..(7): Xaa is C or S
RVPSTXXAPVKT

SEQ ID NO: 6551 - protein, 12 aa, Artificial Sequence
  Building block peptide "PEP"
  MOD_RES (6)..(7): Xaa is C or S
RVPSTXXTPTKT

SEQ ID NO: 6552 - protein, 12 aa, Artificial Sequence
  Building block peptide "PEP"
  MOD_RES (6)..(7): Xaa is C or S
RVPSTXXVPAKT

SEQ ID NO: 6553 - protein, 12 aa, Artificial Sequence
  Building block peptide "PEP"
  MOD_RES (6)..(7): Xaa is C or S
RVPSTXXVPEKT

SEQ ID NO: 6554 - protein, 12 aa, Artificial Sequence
  Building block peptide "PEP"
  MOD_RES (6)..(7): Xaa is C or S
RVPSTXXVPQKT

SEQ ID NO: 6555 - protein, 12 aa, Artificial Sequence
  Building block peptide "PEP"
  MOD_RES (6)..(7): Xaa is C or S
RVPSTXXVPTKT

SEQ ID NO: 6556 - protein, 12 aa, Artificial Sequence
  Building block peptide "PEP"
  MOD_RES (6)..(7): Xaa is C or S
RVPSTXXVSQKT

SEQ ID NO: 6557 - protein, 12 aa, Artificial Sequence
  Building block peptide "PEP"
  MOD_RES (6)..(7): Xaa is C or S
SIPKAXXAPTEL

SEQ ID NO: 6558 - protein, 12 aa, Artificial Sequence
  Building block peptide "PEP"
  MOD_RES (6)..(7): Xaa is C or S
SIPKAXXAPVEL

SEQ ID NO: 6559 - protein, 12 aa, Artificial Sequence
  Building block peptide "PEP"
  MOD_RES (6)..(7): Xaa is C or S
SIPKAXXTPTEL

SEQ ID NO: 6560 - protein, 12 aa, Artificial Sequence
  Building block peptide "PEP"
  MOD_RES (6)..(7): Xaa is C or S
SIPKAXXVPAEL

SEQ ID NO: 6561 - protein, 12 aa, Artificial Sequence
  Building block peptide "PEP"
  MOD_RES (6)..(7): Xaa is C or S
SIPKAXXVPEEL

SEQ ID NO: 6562 - protein, 12 aa, Artificial Sequence
  Building block peptide "PEP"
  MOD_RES (6)..(7): Xaa is C or S
SIPKAXXVPQEL

SEQ ID NO: 6563 - protein, 12 aa, Artificial Sequence
  Building block peptide "PEP"
  MOD_RES (6)..(7): Xaa is C or S
SIPKAXXVPTEL

SEQ ID NO: 6564 - protein, 12 aa, Artificial Sequence
  Building block peptide "PEP"
  MOD_RES (6)..(7): Xaa is C or S
SIPKAXXVSQEL

SEQ ID NO: 6565 - protein, 12 aa, Artificial Sequence
  Building block peptide "PEP"
  MOD_RES (5)..(5): Xaa is C or S
SSVKXQPSRVHH

SEQ ID NO: 6566 - protein, 12 aa, Artificial Sequence
  Building block peptide "PEP"
  MOD_RES (5)..(5): Xaa is C or S
SSVKXQPTQVHH

SEQ ID NO: 6567 - protein, 12 aa, Artificial Sequence
  Building block peptide "PEP"
  MOD_RES (6)..(7): Xaa is C or S
STPPTXXAPTRL

SEQ ID NO: 6568 - protein, 12 aa, Artificial Sequence
  Building block peptide "PEP"
  MOD_RES (6)..(7): Xaa is C or S
STPPTXXAPVRL

SEQ ID NO: 6569 - protein, 12 aa, Artificial Sequence
  Building block peptide "PEP"
  MOD_RES (6)..(7): Xaa is C or S
STPPTXXTPTRL

SEQ ID NO: 6570 - protein, 12 aa, Artificial Sequence
  Building block peptide "PEP"
  MOD_RES (6)..(7): Xaa is C or S
STPPTXXVPARL

SEQ ID NO: 6571 - protein, 12 aa, Artificial Sequence
  Building block peptide "PEP"
  MOD_RES (6)..(7): Xaa is C or S
STPPTXXVPERL

SEQ ID NO: 6572 - protein, 12 aa, Artificial Sequence
  Building block peptide "PEP"
  MOD_RES (6)..(7): Xaa is C or S
STPPTXXVPQRL

SEQ ID NO: 6573 - protein, 12 aa, Artificial Sequence
  Building block peptide "PEP"
  MOD_RES (6)..(7): Xaa is C or S
STPPTXXVPTRL

SEQ ID NO: 6574 - protein, 12 aa, Artificial Sequence
  Building block peptide "PEP"
  MOD_RES (6)..(7): Xaa is C or S
STPPTXXVSQRL

SEQ ID NO: 6575 - protein, 12 aa, Artificial Sequence
  Building block peptide "PEP"
  MOD_RES (6)..(7): Xaa is C or S
TVPKPXXAPTQL

SEQ ID NO: 6576 - protein, 12 aa, Artificial Sequence
  Building block peptide "PEP"
  MOD_RES (6)..(7): Xaa is C or S
TVPKPXXAPVQL

SEQ ID NO: 6577 - protein, 12 aa, Artificial Sequence
  Building block peptide "PEP"
  MOD_RES (6)..(7): Xaa is C or S
TVPKPXXTPTQL

SEQ ID NO: 6578 - protein, 12 aa, Artificial Sequence
  Building block peptide "PEP"
  MOD_RES (6)..(7): Xaa is C or S
TVPKPXXVPAQL

SEQ ID NO: 6579 - protein, 12 aa, Artificial Sequence
  Building block peptide "PEP"
  MOD_RES (6)..(7): Xaa is C or S
TVPKPXXVPEQL

SEQ ID NO: 6580 - protein, 12 aa, Artificial Sequence
  Building block peptide "PEP"
  MOD_RES (6)..(7): Xaa is C or S
TVPKPXXVPQQL

SEQ ID NO: 6581 - protein, 12 aa, Artificial Sequence
  Building block peptide "PEP"
  MOD_RES (6)..(7): Xaa is C or S
TVPKPXXVPTQL

SEQ ID NO: 6582 - protein, 12 aa, Artificial Sequence
  Building block peptide "PEP"
  MOD_RES (6)..(7): Xaa is C or S
TVPKPXXVSQQL

SEQ ID NO: 6583 - protein, 12 aa, Artificial Sequence
  Building block peptide "PEP"
  MOD_RES (6)..(7): Xaa is C or S
YVPKPXXAPTKL

SEQ ID NO: 6584 - protein, 12 aa, Artificial Sequence
  Building block peptide "PEP"
  MOD_RES (6)..(7): Xaa is C or S
YVPKPXXAPVKL

SEQ ID NO: 6585 - protein, 12 aa, Artificial Sequence
  Building block peptide "PEP"
  MOD_RES (6)..(7): Xaa is C or S
YVPKPXXTPTKL

SEQ ID NO: 6586 - protein, 12 aa, Artificial Sequence
  Building block peptide "PEP"
  MOD_RES (6)..(7): Xaa is C or S
YVPKPXXVPAKL

SEQ ID NO: 6587 - protein, 12 aa, Artificial Sequence
  Building block peptide "PEP"
  MOD_RES (6)..(7): Xaa is C or S
YVPKPXXVPEKL

SEQ ID NO: 6588 - protein, 12 aa, Artificial Sequence
  Building block peptide "PEP"
  MOD_RES (6)..(7): Xaa is C or S
YVPKPXXVPQKL

SEQ ID NO: 6589 - protein, 12 aa, Artificial Sequence
  Building block peptide "PEP"
  MOD_RES (6)..(7): Xaa is C or S
YVPKPXXVPTKL

SEQ ID NO: 6590 - protein, 12 aa, Artificial Sequence
  Building block peptide "PEP"
  MOD_RES (6)..(7): Xaa is C or S
YVPKPXXVSQKL

SEQ ID NO: 6591 - protein, 8 aa, Artificial Sequence
  Building block peptide "PEP"
  MOD_RES (5)..(5): Xaa is G, A, V, L, I, P, F, M, W, T or S
EPISXLYL

SEQ ID NO: 6592 - protein, 8 aa, Artificial Sequence
  Building block peptide "PEP"
  MOD_RES (5)..(5): Xaa is G, A, V, L, I, P, F, M, W, T or S
EPLPXVYY

SEQ ID NO: 6593 - protein, 8 aa, Artificial Sequence
  Building block peptide "PEP"
  MOD_RES (5)..(5): Xaa is G, A, V, L, I, P, F, M, W, T or S
EPLTXLYY

SEQ ID NO: 6594 - protein, 8 aa, Artificial Sequence
  Building block peptide "PEP"
  MOD_RES (5)..(5): Xaa is G, A, V, L, I, P, F, M, W, T or S
KPLSXLYV

SEQ ID NO: 6595 - protein, 8 aa, Artificial Sequence
  Building block peptide "PEP"
  MOD_RES (5)..(5): Xaa is G, A, V, L, I, P, F, M, W, T or S
NAISXLYF

SEQ ID NO: 6596 - protein, 8 aa, Artificial Sequence
  Building block peptide "PEP"
  MOD_RES (5)..(5): Xaa is G, A, V, L, I, P, F, M, W, T or S
RPVQXRKI

SEQ ID NO: 6597 - protein, 8 aa, Artificial Sequence
  Building block peptide "PEP"
  MOD_RES (5)..(5): Xaa is G, A, V, L, I, P, F, M, W, T or S
RSVKXAKV

SEQ ID NO: 6598 - protein, 8 aa, Artificial Sequence
  Building block peptide "PEP"
  MOD_RES (5)..(5): Xaa is G, A, V, L, I, P, F, M, W, T or S
SAISXLYL

SEQ ID NO: 6599 - protein, 8 aa, Artificial Sequence
  Building block peptide "PEP"
  MOD_RES (5)..(5): Xaa is G, A, V, L, I, P, F, M, W, T or S
SATSXLYY

SEQ ID NO: 6600 - protein, 8 aa, Artificial Sequence
  Building block peptide "PEP"
  MOD_RES (5)..(5): Xaa is G, A, V, L, I, P, F, M, W, T or S
SNITXQIM

SEQ ID NO: 6601 - protein, 8 aa, Artificial Sequence
  Building block peptide "PEP"
  MOD_RES (5)..(5): Xaa is G, A, V, L, I, P, F, M, W, T or S
SPINXLYF

SEQ ID NO: 6602 - protein, 8 aa, Artificial Sequence
  Building block peptide "PEP"
  MOD_RES (5)..(5): Xaa is G, A, V, L, I, P, F, M, W, T or S
SPISXLFI

SEQ ID NO: 6603 - protein, 8 aa, Artificial Sequence
  Building block peptide "PEP"
  MOD_RES (5)..(5): Xaa is G, A, V, L, I, P, F, M, W, T or S
SPISXLYI

SEQ ID NO: 6604 - protein, 8 aa, Artificial Sequence
  Building block peptide "PEP"
  MOD_RES (5)..(5): Xaa is G, A, V, L, I, P, F, M, W, T or S
SPISXLYK

SEQ ID NO: 6605 - protein, 8 aa, Artificial Sequence
  Building block peptide "PEP"
  MOD_RES (5)..(5): Xaa is G, A, V, L, I, P, F, M, W, T or S
SSLSXLFF

SEQ ID NO: 6606 - protein, 7 aa, Artificial Sequence
  Building block peptide "PEP"
  MOD_RES (1)..(1): Xaa is absent or any amino acid
  MOD_RES (2)..(2): Xaa is absent or any amino acid
  MOD_RES (3)..(3): Xaa is absent or any amino acid
  MOD_RES (4)..(4): Xaa is absent or any amino acid
  MOD_RES (5)..(5): Xaa is absent or any amino acid
  MOD_RES (6)..(6): Xaa is absent or S, T, C, E, Q, P or R
  MOD_RES (7)..(7): Xaa is absent or S, T, C, E, Q, P or R, and at least one Xaa is not absent
XXXXXXX

SEQ ID NO: 6607 - protein, 4 aa, Artificial Sequence
  Building block peptide "PEP"
SIAN

SEQ ID NO: 6608 - protein, 4 aa, Artificial Sequence
  Building block peptide "PEP"
SIAS

SEQ ID NO: 6609 - protein, 4 aa, Artificial Sequence
  Building block peptide "PEP"
NIPS

SEQ ID NO: 6610 - protein, 5 aa, Artificial Sequence
  Example of Bioactive carrier-affinity-contaning group
GTPGP

SEQ ID NO: 6611 - protein, 5 aa, Artificial Sequence
  Example of Bioactive carrier-affinity-contaning group
WWFWG

SEQ ID NO: 6612 - protein, 20 aa, Artificial Sequence
  Examplary primary structure supporting PEPREF 3D coordinates
KIPKACCVPTELSAISMLYL

SEQ ID NO: 6613 - DNA, 22 bp, Artificial Sequence
  PCR Primer
aagctaccactgataactcgcc

SEQ ID NO: 6614 - DNA, 22 bp, Artificial Sequence
  PCR Primer
cttctttaccctcatcctgtcg

SEQ ID NO: 6615 - DNA, 20 bp, Artificial Sequence
  PCR Primer
cactgttaccgccacttccc

SEQ ID NO: 6616 - DNA, 20 bp, Artificial Sequence
  PCR Primer
accagcggaagtccccttcg

SEQ ID NO: 6617 - DNA, 20 bp, Artificial Sequence
  PCR Primer
gctctgtggcatacaggaga

SEQ ID NO: 6618 - DNA, 20 bp, Artificial Sequence
  PCR Primer
catagaatcgcaccctgatg

SEQ ID NO: 6619 - DNA, 20 bp, Artificial Sequence
  PCR Primer
gacgtgcccaggcgtatttc

SEQ ID NO: 6620 - DNA, 20 bp, Artificial Sequence
  PCR Primer
aagtctggggtccgtcaagg

SEQ ID NO: 6621 - DNA, 20 bp, Artificial Sequence
  PCR Primer
gcagtacagccccaaaatgg

SEQ ID NO: 6622 - DNA, 22 bp, Artificial Sequence
  PCR Primer
acaaagtccggcctgtatccaa

The invention claimed is:

1. A peptide that is up to 30 amino acids in length and that comprises an amino acid sequence selected from the group consisting of SEQ ID NOs: SEQ ID NOs: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

2. The peptide of claim 1, wherein the peptide is up to 25 amino acids in length.

3. A medical composition comprising at least one peptide according to claim 1, and a medically acceptable carrier.

4. A peptide that is up to 30 amino acids in length and that comprises:
the amino acid sequence selected from the group consisting of SEQ ID NOs: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904; and
at least one biomaterial-affinity-containing group, wherein said at least one biomaterial-affinity-containing group provides said peptide, with the ability to covalently or non-covalently interact with a biomaterial.

5. A functionalized biomaterial comprising at least one peptide according to claim 4, and a biomaterial.

6. A medical composition comprising at least one functionalized biomaterial according to claim 5, and a medically acceptable carrier.

7. A medical composition comprising at least one peptide according to claim 4, and a medically acceptable carrier.

8. A method of inducing bone cell differentiation, bone tissue regeneration, or bone tissue formation comprising:
administering an effective amount of a peptide to a mesenchymal stem cell or progenitor bone cell at any stage of differentiation thereof,
wherein said method is selected from the group consisting of a pharmaceutical method, a surgical method, a dermatological method, a prophylactic method, an imaging method and any combination thereof,
wherein the administration is in vitro, ex vivo or in vivo, and wherein
the peptide is up to 30 amino acids in length and comprises an amino acid sequence selected from the group consisting of SEQ ID NOS: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

9. The method according to claim 8, wherein said method further comprises preventing, or treating a disease, condition, disorder, or pathology, or enhancing, promoting or inducing a medical application in a patient, wherein said disease, condition, disorder, pathology or medical application is selected from the group consisting of:
enhancing osteogenesis, inducing bone formation, inducing osteocyte maturation, or treating or preventing osteoporosis.

10. A method of inducing bone cell differentiation, bone tissue regeneration, or bone tissue formation comprising:
administering an effective amount of a functionalized biomaterial to a mesenchymal stem cell or progenitor bone cell at any stage of differentiation thereof,
wherein said method is selected from the group consisting of a pharmaceutical method, a surgical method, a dermatological method, a prophylactic method, an imaging method and any combination thereof,
wherein the administration is in vitro, ex vivo or in vivo, and
wherein the functionalized biomaterial comprises at least one peptide and at least one biomaterial-affinity-containing group, wherein said at least one biomaterial-affinity-containing group provides said peptide with the ability to covalently or non-covalently interact with a biomaterial, and
a biomaterial, and
wherein said at least one peptide is up to 30 amino acids in length and comprises an amino acid sequence selected from the group consisting of SEQ ID NOS: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

11. A method of producing a physiologically functional and healthy bone cell, comprising:

administering an effective amount of a peptide to a mesenchymal stem cell or bone progenitor cell, at any stage of differentiation thereof, wherein said physiologically functional and healthy bone cell is selected from the group consisting of an osteoblast, and osteocyte, wherein the administration is in vitro, ex vivo or in vivo, and wherein the peptide is up to 30 amino acids in length and comprises an amino acid sequence selected from the group consisting of SEQ ID NOS: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

12. A method of producing a physiologically functional and healthy bone cell, comprising:

administering an effective amount of a functionalized biomaterial to a mesenchymal stem cell or bone progenitor cell, at any stage of differentiation thereof, wherein said physiologically functional and healthy cell is selected from the group consisting of an osteoblast and osteocyte, wherein the administration is in vitro, ex vivo or in vivo, and wherein the functionalized biomaterial comprises at least one peptide and at least one biomaterial-affinity-containing group, wherein said at least one biomaterial-affinity-containing group provides said peptide with the ability to covalently or non-covalently interact with a biomaterial, and a biomaterial, and wherein said at least one peptide is up to 30 amino acids in length and comprises an amino acid sequence selected from the group consisting of SEQ ID NOS: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

13. A surgical method for surgical treatment comprising:

contacting a body part of a patient to be treated with a peptide, wherein said contacting induces stem cell differentiation and bone tissue formation, and wherein the peptide is up to 30 amino acids in length and comprises an amino acid sequence selected from the group consisting of SEQ ID NOS: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

14. A surgical method for surgical treatment comprising:

contacting a body part of a patient to be treated with a functionalized biomaterial, wherein said contacting induces stem cell differentiation and bone tissue formation, and wherein the functionalized biomaterial comprises at least one peptide and at least one biomaterial-affinity-containing group, wherein said at least one biomaterial-affinity-containing group provides said peptide with the ability to covalently or non-covalently interact with a biomaterial, and a biomaterial, and wherein said at least one peptide is up to 30 amino acids in length and comprises an amino acid sequence selected from the group consisting of SEQ ID NOS: 1, 2, 3, 20, 21, 23, 26, 27, 28, 33, 95, 96, 102, 105, 106, 107, 108, 109, 110, 111, 112, 113, 114, 1071, 1144, 1181, 1214, 1300, 1354, 1361, 1369, 1382, 1484, 1902, 1909, 2041, 2116, 2148, 2166, 2198, 5649, 5660, 5674, 5687, 5693, 5702, 5710, 5715, 5733, 5737, 5751, 5752, 5771, 5794, 5804, 5808, 5831, 5841, 5856, 5881, 5885, 5886, 5899, and 5904.

* * * * *